United States Patent 12,031,129 (METHODS AND COMPOSITIONS FOR MODULATING A GENOME) - sequence listing, part 2

SEQ ID NO: 1026 - DNA, 4204 bp, Oryzias latipes
cgcacaggggacacagagcctgcccaagtaccgctcccgagggagcgggaaacgggggggtgactatcccctggggtccggcgagagcgctggtctacggaccaggggtggctgtgggcaggctgctcctcaggccagttgattagttacgcatgggctgtacctccacgtggtcccgctggtaacgacttgtcggctaaatcagcccgcccaccatctgggatatggttgaccgtctaaccccagtactcaggtcacaaacaaaatgggaacagatacagtgtatgtcggccaggactacccttctggcttatcaaaacgggtaccagcacggttagtggcgggaccgatgctgcgagagcgaagctgtcacgcccatgtgtttagggctggacacatgtggaactggcgaaccagccttccgagcgggcgctgggaccagcccgctttggagaagtctcgggtcctaacccggtcggtggcgacggccaccgaccccgaaattacctcttacccaggaaagtccgtatcgacaagtacgcaggttcaggaggaggactggtgtagccgggagagcgggtggatctcgccaggacttgctcctgaagaaccctcggtggtgtccgaaattacagcctccatggtagcgacaatgagggtagcaaccgaggaggtcgtgctggaaccacagcctgaacaggtcgtcacaatactgccggagcatggtcgaaacgttcctccggggctggcagaacaggacaccgccagccccatagaagtctcggtgctcctcccagacctcgctgagaactgcccattgtgtggcgtgccgagcgggggcctacgcttgctcgggaagcattttgctgtccgacatgcgggggtgcctgtaacgtatgagtgccgtaagtgtgcgtggcggagccccaacagccactcaatctcgtgtcacgtccccaaatgccgggggcgtgcgcggatgcccagtggcgatccagggatcgcctgcgatctctgtgaagcccggtttgccacggaggttggggtcgcccaacacaagcggcacgttcatccggtggagtggaacaaggtgaggctggaaaggagaggtgcgcgcggagggggaattaaggcgacgaagctctggagtgtagcggaggtagagacgctaatccggctcatccgtgagcacggagattcaggtgccacttaccagctcattgccgatgagctgggaaggggcaagacggccgaacaggtgaggagtaaaaagaggctcctgcgcatagatacggcaagcaatagcccagatgatgcagaggttgaggaggagaggttggaatctctggcggttcggtcctcgtcacggtcacccccgagcctggtggcgaccagggtcagggaggcagttgccaggggtgaatcagaaggtggcgaggagatcagggctattgctgctctcattagggacgtagatcagaatccttgtctgattgaaacctcggcgtcggacatcatctcgaagctgggaaggagggtggatgggcccaagagacccaggcccgttgtcagagaacagacccaagagaagggatgggtaaggcggcttgcccggcggaaaagggagtacagagaagcgcagtacctgtactcaagggatcaagcaaggctggcggcccagatcctcgatggtgccgccagccaggaatgcgccctcccggtggaccaggtctacggagcgttccgtgagaaatgggaaaccgtagggcagttccacggacttggtgagttccggacgggtgcacgcgcagacaactgggagttctactctccaattctggcggctgaggtgaaagaaaacctaatgagaatggctaacggcacggccccgggaccagacaggataagcaaaaaggctctgcttgactgggacccccggggtgagcaactggcacggctgtacacgacgtggctgatcggtggggtcataccaagggtcttcaaggagtgcaggactaagctgctaccgaaatccagcgacccggtcgagttgcaggacatcggtggatggaggccggtgacgattgggtcgatggtgactaggctgttcagtcggattctaacgatgaggctaacccgagcctgtccgatcaatccgaggcagcgcggtttcttggcctcctcgagtggatgcgcggaaaacctgttgatctttgacgagatcgtcaggcgctcgaggcgggacggggggccgctggcagtggtgtttgtggactttgcgagggcctttgactccatctcacatgaacatatcctgtgtgttctcgaagaaggcgggcttgacaggcacgttatcgggttgatccgaaactcgtacgtggattgcgtgaccagggtgggttgtgtcgagggcatgacaccaccaatacaaatgaaggttggagtgaagcagggagaccccatgtcccccttgctcttcaacctggctatggatcccctcatccataaactcgagacggccggaactggactgaaatggggcgatctttcaatcgccacgctggcctttgccgacgatctggtgctggtgagtgactctgaggaaggcatggggaggagtctcgggattttggagaagttttgccaactgactgggctgagggttcagcccaggaagtgtcacggtttctttatggacaagggcgtggtgaacggctgtggaacctgggaaatctgtgggtcaccgatccacatgattcccccgggggaatcagttcgttatttgggagtccaggtaggcccggggcgcggcgtgatggaaccggatcttatccctacggtccacacgtggatcgaaaggatctcggaggctcctctaaagccctcacaacgcatgagggttttgaactcattcgctctcccccggataatttaccaggccgatctagggaaggttacggtaaccaaattggcccagatagatgggattgtccggaaggctgtgaagaagtggctccatttgtcaccatccacgtgcaatggactgctgtattcacggaaccgcgacggtggtttgggcctcctaaagctggaaagactaatcccatccgtgcgcacgaagcgtatctatcggatgtccaggtctccggatatctggacacggcgaatgaccagccattctgtgtcaaaatctgactgggagatgttgtgggtccaagcgggaggtgagaggggcagtgcacctgtaatgggtgccgtggaggctgccccgaccgatgtggagagatcgccagactacccagactggcggcgtgaggaaaacctggcatggtcggccctgcgggtgcagggtgtgggtgcagaccagtttcgaggcgacaggaccagcagctcttggatcgccgagcccgcttcggttgggttcgcgcagcgccactggttggctgccctggcgctgagggctggggtgtatccgactcgggagtttctggctcggggtaaggaaaagtcaggagcagcttgcagacgctgcccggccaggttggaatcatgttcacacatacttgggcaatgtccgttcgttcaggcgaacagaattgcgaggcacaacaaggtgtgtgtgctcttggccacggaggcggagaggttcggctggacggtaataagggagttccgtcttgaggacgccgctggcggtctcaagatacccgacctggtttgcaagaaggccgacacagttctcattgtcgacgtgaccgtccggtacgagatggatggagagacgctaaaaagggccgcatcggagaaggtgaaacactatctcccagtagggcaacagataacggacaaggtcggagggcgttgctttaaagtcatggggttccctgtaggtgctaggggaaagtggccggcgagcaacaacacagttttggctgagttaggcgtccctgcaggtcggatgaggacctttgccaggctggtgagccggaggactcttctttattctttggatatattgagggacttcatgcgtgagccggccggcaggggaactcgggttgctctcatccctgcggcaacgggtgccgcgaattgagggggacagctgggagtctcggcatgattacaaatcttgcgctgcactcggatgtcgtccccgtgacggacacattaatccggaaagcgagtggtgactcgcctcaag

SEQ ID NO: 1027 - DNA, 4495 bp, Limulus polyphemus; identical to SEQ ID NO: 140

SEQ ID NO: 1028 - DNA, 7028 bp, Caenorhabditis elegans
gctcactttctatcgtgttaaccgtacgtttacactcccagtgagtgtaataaaggttattcgatagagggtgtctccctctttcttgggtaattcttcggcggtccggggtctctccctcgtcttttttttaaacttttctttctcatccactcttttgctcctttttactaactcttgtactctatagtcttttctcatcccccatccgccgttgggcaaagtttatttactttgttaaatccatattttatctctctcacccgtacagaaagcgtctccttctcaaacgcttttctgtactttttcttatattttcattaacatatttttcctgtttatactaacctaacctccattgtcaattactaactaacttgtacaacggatttcgatgttgcgccgaaaaggacgtcaccgaatggttatggtcaattctgtcaaatggcaacccagtgcacatgctgaagcaattggaacaggaaagtcctgggcaccacagcggtcccaggcatccgaacacggctggcaatcaaatgcaatgtttgatccccccaacaggattctcttcgccagagactcatggtcgctcaaccaatcaacgcatcttcaaaatcaaaggagcggatcaggattgggtataagacctggtcaggtaaggaacaatatggtggggggtgggcctcacagagcaggggacccaaagcgtcgtgtcgagctggtcagcatacaaggaagcgaagtgaccgtcagaacaatctacccgtcggatgaaatattcagttgttactccaaatcatgtgatatcaaaacaaaagctggctatggccctgaggacctaaagcacctgactcgtcatatcaagaacgagcatggtctcaaagctcgctgggcatatcaatgtggattgtgcaatgagaagtcggacccaagtgtatcggaaggccacaaatggatggaggcacacatggtcgccgttcaccaaagctctgcggaaaaaaggataaagtcctatcagaaatgcacgggtgcaagagttgcagaacagctacaagctgctgctccatcgcttactgtgccggggaagcacaaatcaggctctagagacgctgccaaagattcgatgacaccaacaaaggatgatgacccgaaaaccaggatctatcagacacgaagcgtagttaaaaagtcgactcagaaaacagcagagccaacagatgaagggtctagaggcccaaagtacgcatccatttttcagaaatccgtcaaagcaaggaagagcttggcgcttctctgtgaattaagcagccctaagcctatgaacccccttcctacaaatgagctaactctgaaagaagggaattcaagagagctcgccaaagaggaagcaccatctgaaggtatagacgacatcgtcatcatcgatctggacgaatcggaggagtcgccacccagaaggaaacgattcaacacctggtgtctggatcatgagtcaagccgtgaagcatggctggatgacacagcaatcttctggtacatctcctatctctgcagaggaagtacaaagtactcagctttggacccatgcctctggagtatgtacaaagtcaaaggctcaagatacattcttgaccgcttggaaagctccatcacatattttttcccgatatgcgaggaggaccattggacactgttggtattgaaagacaattcatactattatgcaaacagtctgcaccaagagccacgtggcccggtcagggacttcatcaacgactcaaaacgggctcggaaggagtttaaggtgcaagtacctcttcaaagagactcctttaactgtggagtgcacatctgtctaatgaccaactcgattatggcaggaggcaaatggcactctgaagaagacgtcagaaacttcagaaaaagactgaagaagacactccaggaagaaggctatgagctttactcggtcaatagtctgggtataccattccaagccccaacgactgagcaaatggactacaaagaaacaagatgcaaaagaagctatgccagtgttcttactcaaataagcccgccggccaaaaggccggactgcaaacctgacaacaacatattcgtaccaaccaaggattgtgctgccgaaggtaacccgcaggaaaaaggccgaaatgaatctcctgaagagatcaatacggaacatatcgtcgtcgcaggaaaacctgcaaacaacatcagtccaaggtgtcggagcacctcggaaatgctgtttgagatggtgaaagccacaaccagcagtggaagaagcagcttgggcaccatgacgcaggatgagttcatccgaaccagcacaatcgccgaggcagttcccctaatgagcataaaactcccaccaatggagttgccaaggaaaattctgccaccaattccccccagaaaaccaacccaaaccaatggaggtcaaaagggaaagcaacagagggtgcctacaggaaaaccagacaccctaaatgctaaagtccggaactggttcaacaaccaacttgagtcgtatgcgatggagggtcgcagcttccaacgactggaatggctgacggaagtactcactgcgtcgatacaaaaagcagcagcaggtgatgaaggaatagttgatattatttgcaaacggaacccgccacttgaagttgcgaagggtgaaatgtgcacccagaccgaaaacaaaaggaaaacgaccaacaatgcagcaagaattgcggacccaatccagagcagcaagggagctggtgatgtgaaggcatcgtactggaaagaaagggctcgcacttacaacaggattattggtagcaaggaggaactctgcaaaattcccatcgatcaactggaggatttcttcaagaaatccacgtcccgcaccaacgtgcaggagtcgatcatgaaggagaaaagctccaaaattcctgctctcaagataggtaactggatggagaagaagtttatcggaaaggaggtggcgttcgctctgcggaaaacaaaagacaccgcgcagggtgcagacggactgcgataccaccaccttcaatggtttgatcccagtggtgagttattggcgaaggtatataacgagtgccaacgacacaggaagatcccaaaacactggaaggaggccgagaccatcttgctgttcaaaaatggagatcagtcaaaaccagaaaactggcgcccaattagcctgatgcctgtgatctacaaactttactccagtctgtggaaccggagaattagagctgtaccaaatgtgttgagcaaatgtcagcgagggttccaggagcgcgaaggttgcaatgagagtctagcaatactcagaacagcaatcgacgtggccaaaggaaaacgaagaaacctggcggtggcatggctggatctgacgaacgcgtttggatccatcccgcacgaattgattgagtacgcgctgacagcgtatggatttccgcaaatggtcgtcgatgtggtcaaagatatgtaccagggagcatcaatgagggttaagaacgcgacggaaaaaagcgatcgaatcccaataatgtctggggtgaaacaaggcgatcccatttcaccaacacttttcaatatatgcctggaaactgtgattagaagacacctggagtctgcaaatggtcaccagtgcctcaaaacaagaattaaggtactggcgttcgccgacgacatggcgattttaacggattcccccgaccagctccagcgagaactgtcaaagctagacaatgattgcacgcccctgaatcttattttcaagccagcaaaatgtgcatcacttgtgatccaaaaaggagttgtgcggagcgcatcaattaagcttaaaggaaacgccattcgatgccttgacgagaacaccacttacaaatatttgggagttcagacgggttcggcagcaagaatttcagcaatggatctactggagaaagtcacgaaggaacttgaatgcgtggtcaaaagtgacctgacgccgccgcaaaagctggactgtcttaaaacattcacgctgtccaaactgacatacatgtatggaaattccataccactgatcacggagataaaaatgtttgcaaatatcgtcattcgaggagtcaaagtgatgcatagaatcccagtccgagggtcaccactggagtacatccatcttccagtgaaggatggagggcttggtgtagcatgtcccaagacaacctgcatgattacgttccttgtctctactcttaaaaaactctggtcagatgatgaatacatcaaaacattattcacatcactggcggaagaagtagtaaagaaagagtcaaagaagagcacagtcactatggatgatatagccgactatctcaacgttgaggagaggatcaataggagcgaatttgggtacaattccattacgagactgcgggatgtgatgaggaacttggccatcactggcgactccccactttacaggctgaaaatggtagtaaagaacgggaaaatcgctttgctcgtccaagccacaagcgaaagcatggaaaggatctacacggaagaagatgcgaaaaagctgcagcgctcactgaaggatcaagtgaacaaagcactcaaacatcgattcaacaccaccaaagtagtgaaaagcaaagtcgtccgagtcgtgcaacagcacccagcaagcaacaggtttgtcacaaaaggtggcaacctgagccttgcatgtcaccgctttgtgcataaagcacgtctgaatctactggcctgcaactacaacaactacgacaaatccaaatcaaaagtctgtaggcgttgtgggaaggatctggagacgcagtggcacatactgcaaaactgtccgtttggtttctcaaagaagatcactgagaggcatgatgccgtcttgcacaaggtcaaaactctcattgaaagcggtggaaaaaagaattggacaatgaagattgatgaagaacttccaggattcagcagactccgtccagatatctgcctcaaaagccctgatgaaaaacaaatcatcttggcagatgtcgcatgcccatatgagcatggagtagaagcgatggaaaggagctggcaggcaaaaatcgacaaatacgagacgggattcgcccacctgcggaaatcgggaaccaagctgaccgtccttccgattataatcgggtcacttggatcatggtggaaaccgacaggtgacagtctcaaggaattgggaatcaagggaagcgtgatcaacagtgccattccagaactctgtgctactgttctcgaacacagtaagaatacgtactggaatcacatcttcggtgaagcgtacataccaaatccaatgcgaaacggacacgcaaaacctgctggaaatggatggaaaaaggaaagattgcagaaggcccctgtgaggcctaccaactagcctccagggcacgccgcacgccaaaagtcctggcataactctgcaaataacatcaaacgtcaatcaactccacaaactctccactctcttcaagtcttctcggtgcttccaacaccacaatggtgaaagctccttcaccttttccctccaaaattcttcccatgtggggaagtcctgttcttgtaagctctccggaggctgcaagagcagaagaaattcttctttctgacaaggtcagaaggaagtcctgttcttgaggcgtccatcccgggcgtcataggagagatcagatgcaccttctagcaggagctagaagggctgccctgtcttgagatccccacgggggtcaatagacgggaggggctgctggctttctctttttaagaggaagcaccaatccggagatccttaggggtcaaaggattaaaaggcagcaggtccaattctcctcactgacttcggtcagagaggagtcccgccttggagacctccccggggaggttgctgaagaggcggaagctccttctagcaagagctagagggagttcccagtcctgaaacccttgcggttgatgatggaatggaagagtacttcggtactgctcgttgctctctctgcgttttactgccgagggccggatttgctcgaatcgcgaaaggtctcaatcgaccattcaagatgacggcttatctaaggtccgaaagcagttgggagagtaacgtgttctcctacctttcaagttgaatggtcgttttactgtttgggatagctgacttgatgctagtacgcttcatctgtggatgacgctccccaagcagtcaagtagacttgaaaggtgccctcgccctagttagctcttagaccttatgggtcgccatggttgtggacgggtatgcttgccggagccgagtcgtgtttcttagaaccaacctcgacgaggcgaaagcttgcacaagttagcacaattgtggtagggccgactagaaaatgagtcccttagggggttacgccttggcgaaagtgaggacaattggcattgacgggtgcttcggcactaggcaaaggcgccaccacactgtccaatctctaaaaagttcacattcatcgaagaactaccggaaccaaccacacatgtgttgaaacctacacggtggaagggaaaggaaagcttcgctggaacgaaaagaacggataggttccccttcttgatggctgtgaggcttaggatggacgggaaggccgtgaggcctcaggcgggtaactcggccagacgctagttgatcttcggatcacgacagccctggctaagaggaaccctggatggagtgtgaaggatgggcgggtagggggttaagcctgttgacagaccaccgactgcagtcacaaaatcagtgattatgcgggtggaccaatctgttggcgggtgtttccctctacctgaccccgcaatatggtatgtacgatcctcggatctaaaattcataatggcccaccacaaccataaacctccctagcagctggtggtcccgataattcgggttcttgccactactgcgacccaggctcgcc

SEQ ID NO: 1029 - DNA, 3376 bp, Cryptococcus neoformans
ccctcttaataccccataacacataacaaccccctaatcaacgttctctgcaccttaaacaccaccaacatgtccctgcagagggccaaaaacgcccgtggagatcctggtcggtgcaacctatgctctgccgactatagggacctcaaagatcatctcaataaacaacattccacccatttcttcgtcccctccgacctccgtggctcttccctagtcgcttgccctcgctgcggcaccccctgctcagctggcactggtttatctcgtcaccagagccggtattgcggtctcaccgctcctcgaatccgccgaaatcgcgtgggaaactcaacaaacacatctcgctgccctccctccaatactgcagcttcacccatcgttccttcgccttccccagaacgcccaagcccccctcagcctgctgaagttgttgccagtctcgaaccattgtctgaagccgaggaggtgctggaggtcgcccaggttgatgccgagactgttgacacgctggaagggacccggagagctccggaatccgttccgagatctgccgaggaaggtagcacgcgagttagggagctaaacatgacagcgccggaggaggagcatcgtggggaggaggagagtagtcataccaacccaactgccccagcagggctcgagaacgcggtgagctcaacgctggggccttcccctgggacgttgccttccttacttccgtcccaagagtgtgctaacgaaagattcctgtaccttgcgcacctgcctgttcggagcaagcctctgcccaacaacctagttaccgacttcatggacgccgctgagcgttgtgctcttgcctacattgcacaaccctcggactctacactgctggcatttctcgcccttccaaaggtcggcctcacccaggcgctcgctccagaacagcccctcaggccgtcaaccttccttaagcagttcccgcatatcccctggccagaacagccacccgctcgtcgtcctcccagcaatattcgtccagacaccaccaaacaagtcatcaaactcgttgagaatgggcgcctaggtgcggcagagagggtgttggaggaggatgcttcagtagccgaactcgatcaaggggtcatcgaccagctcatcaccaagcaccccaaagggccgtcttgtccattcggcaatgcagtgggtccaactcctggtaaagctcccgacatcgacaccatccaaaaggccctcgactccttcaagcccgacacagcacccggcgttagtggctggtcagtccctctcttgaagacggctgccaagagggagccggtcaagcagtttctccaactcctctgcgccgccatcgccaacaacaccgcccctggtcgctctatgctccgcacttctcgtctcatccccttgaagaaggacgatggctctatccgacctatcgctgttggtgaacttatctatcggctgtgtgcgaaagctctcatcatctcgcatttccaacccgacttcctcctcccgttccagctcggggtcaagtcaatcggtggtgtagagccgatcgtgaggctgacagagagagtcttggagggttctgccggcgctgagttctcctttttagcctcgctcgatgcttctaacgctttcaaccgtgtagatagggccgagatggcagcagcggtcaagacccatgcgccgacgctttggaggacatgcaaatgggcctatggcgactcgtccgaccttgtgtgtggtgacaaaatccttcaatcctctcaaggtgttcgacagggtgacccctttggccctctcttcttctcgatcaccctccgaccaaccttgaatgccctcagtcaatcgctaggtccgtctacgcaagcactcgcttacctcgatgacatctacctcttctcaaacgactcgcaagtcctcagcaaaactacccaattcctcgccgacaagcagcacatcatcaagctcaatgaaaagaaatgcaagttaatcagcttcgatgagatcaggcaggagggcttcaagatgctagggacgatggtaggaggtaaggagaagcgagcggagtttctggaaggcaggattcggaaggaaatggcaaaggtgggcaagctcaaggatcttccacatcaacacgcgctccttctattacgtttctgcattcagcaaaatctacgacacctgcagagaagtctgcgctcggacgaccttgtagacctatgggagaggctggacacgatgctatgggaggaggtgaaaaggatgaggatgaggcagcgggaggatacggcggaagaggaggctctagggagatcgttgacgaagctaccagcgcgactgggcggactaggtctactttccttcaaagatgtagccccccttgcttaccgctcggcagccgaggcctccgacactctcctcgataacctaggtctcctttcttcgccagaggaacctccaactccgatcccccaacgaactcgatgcgcagaactctgggaatcgcaacaggaagccatcctacataacctcggcgacactgaacgcaagcgactcaccgagaatgcctccagactcggccgaagttggttatcagttatcccttaccttcaacccctgcgcctttccaatgtcgagattgcctctggtctccatgaccgcaccctggtcggctcctcgatccctgtctgtcgcttctgtgggtcggactcacctttgggtcacgacgagctttgccgcgcccgcaacccctggacccagcgccggcacaatgccatcaaccgcgtcatttatcaacacctcaaacaaattcaaggtgccacggttgagattgagccccacacgctgtcgggacaaaggagaaacgaccttcgggtcagaggttccagcgctctggccttcactgactacgacctgaaggtttactccctcggggaccgagacgcgagaagcaccgtcacaccctgcgcccccaacggcaagctggccgacttctgcttggaccggtgcgtgaactggctcgacaaggtgggtcaggtcgtctctaagaacgctccgaaggtcactggtggggtctttaaaccaatcatcctttccactggtggcttgatgagcaggagcacagcagacgaatggaaggactggagggacgcgatgccggtgggggggttcgagaaaatggagaaacggattggtgtcgagttagtaaaggcaagggcgaggacgctggtcttatgaggaagaggaggttggattattttttcttttctttaataagttgtttatttaagtagtttctttcattcgggcaacccacacgacaacccaataaattaaacaacgaaaaatgcaacctctataaccc

SEQ ID NO: 1030 - DNA, 3234 bp, Chondrus crispus
acgccccctatccatttctgccagcctcccatcggctcgccgtctccgcaacccctcttcctcggctgtaccagttccgctcccacaacctccctcgccacaatgagtcaacctaatatttcgtccgctgagacccccttgtctcagctgcccacgcctgttcccaccccgccttctccctccaatccctctctctctctccctactgtgcgtgacctcctcctctgccccatacgctcctcccatgtttactcatccatcccttcctcgtgcttacacagtttcacgatgctcctcatcaagactgtccgcgctgcgtcggccacaatgaccccaactgaatcmcatcgcgcattcattcatctacacattcttcccatcgctgtcttgcgacgctcgttccgtggagaaaccggatggcgttcccgcacagggcaacatcatgccctccgccaacggattcgccgcgcctcctcgggtcggcattgggctgccttgtggcacgaagcccttgctgcacatcaggtcgaccttgactaccgcacgcgtcacagccgtcgttaccaagcctccgctacatcgcgccaccgcatcggccgtgccatgcgtctggccgccgatgcccaatatggacgtgcaatgtcggccctcaaggccaaaccgctgcccgatctacatgctgccgccacccgcgacacactcaccgcgcttcaccctcctcctgccagcccggttcagcctctctcaccgactgacctccccccggtccctgaaattacggaaggtcaagtcctccgagcggcacgcgcccttaatcccacatccgctgcaggaccggaccatctctctccccgtatcctgcagctcttagcccgcaccactatcagcccggaagctggggttacggggttgtccgcattgacgaacctggttcgacgtctcgcccgaggtgacattccggatagaactgcgcctctccttgctgctgccactctgatccccctccaaccccgccctcacaaaatacggccgattgctgtagggcaggctttgcgccgtctggtcacgaaggtccttctgccccccgccatccaggacacccgcgatcaccttctcccagaacagctcgccaactcggttgcctcgggcatggacgcaatcgtccatgacacgcgcatgcttatgcatcgtcacggtcgaaacccagactacatcatggtctccgtagacgcgcggaatgcctttaacaccttctcacgtcagtccctgctggatcgtctccctctgcagactccttccctcgcccgttttctcaatctaatctatggccgcaccgttcctgatctcgtgctgccctcttctccgcggtttctgatgaaaagtcaggagggcacccaacagggggacccggcaagtatgctcttattttcgctggcaatccagccgctcctgcgtcgtctcacccgcgagtgccgtctcgacctgaaccgctggtacgcggatgacggcactctggtcgggccaatctcggaggtcatcaaggcactccgaattcttcgtgatgacggcccgcagtccggatttcacgtcaatatcaacaagtgccgggcatactggccgaccgtaatgccagaaaagttgtccgaattgctccgtatcttcccccttcacgtcgagtgcggcgaaggcggtgtcgccttgctgggtgccccgctcggcacagatgcctttgtgcgccgacatctcatgaacaaggttcaatcatgccatgcctccctcagcctccttgatgaaattcccgacgcgcgtacgcggtttcaccttcaccgtgtaacaggctcggtatgcaaagtcgagcatgtttttcgccttacacctccccacctctccctcccagcagctacaaaatttgatgaacaacaaatcgctgcttattctcggttgaatgatgtggccgtttccacatccatggctacacaaataggccttccgtttcgcctcggtggacacggcttcaccccactgtcaccattcatccatgcgtcctacgctgccagtttaattgaggcggcacctgttcgtgtgaagggcccacataacccctccgagtcgttttatcgccgcatggcccgtcgtcatatcgtccacgtactaggggccttgaaccctgaggtccgcacccgaggcattcttgggacccattctcccctcggaccatttgaaccagaggcccttttgtctagacctgaacgcgtacaccacacattaattcaggctatgcagggggccacttctcgactctactgggaacacaccgcgtgggaccttgaccctctccctcgcaaccacagtgccgcctctgtccgccgacgtgcccggtacaattccctccgtgctccgggcgccgcgtcgtttctatgcagccacccctcactcacttctcgagtcccttctgcggtgtggtcctgtatgctacgccggcatctggatacacccgtctactgtgactctattcggcctctcatatgttcgcattgctgtaagccaatggacgctcgcggtgatcatgctgcaatatgccgtcatggcttcggcgtcgttcaccgtcataacactgtacgcaacctactcgcccgtcacgcgttccgcgccgccggtctctgctgcgaccttgaggtcccttctctcttgccgaataccgcgaaccgccccgccgatattctcgtccagcccgccccgcctccttcgggcgctctcccggaccgccccactgcgtacgacgtaaccgttcgttccccctactgtcgctctacaatgtctctcgctgcgaaaggcctcgcgggtgcagcggaagctgctgatttggacaagcttcgcgtccattcccgtacagtgcgtgacgcatttcacctccagcctgactccccactccctctactcgactggcactttgtcccgctcgcatttgatactctcggcgcgaccagctctcgcacgatggcagtccttgagtacctcgctcaccgcattgccaaccggacatattcatcttacgggaccgccaagatacgtctactacaacgcatcagtttcgctgtttggtccagtttggcctctgccaccctttcccgtatgccctatcacggcgcggccctatcgagccccgcccaagtgtaagtccttgacgcctgccccgtgatacagcatcggtacccctagcatttgaataaaaaa

SEQ ID NO: 1031 - DNA, 3732 bp, Chondrus crispus
  modified_base (2)..(2): a, c, t, g, unknown or other
cnccagccamcgatcccgccgccactcgcmgcccggccgtctcgaccgccacctccccgasgccccagcccatcatggcctstwmgccccwgatwtctcccccgggggccccccctgctccgctgcggtaccggatgttacaatgtccaccsccgctaccsaagcsmcastmgttkccggtcccccacccgatgtcgtcacccatacgcckccgcctcccmcaccggmcgatgaggggacccccttcccsaacccctccccgagacatgcacagaccscatggcacccccggwccgcactctcaccgatkctgtggccgccctcccmaccactgcacccatgcctccscacaaccscgsmsagcccmgcacsctctccaawggccgaaactscgcagcccacctccacatccgcatgtttcacccctcatcctctgcastggccccctcccaacgcccatgacccaaccacgcatgaaacgagcgctctccasaagcgccaaggcgccccctaccaagcgcccctctgcctctcagggcccagccgcgtcttcccatgackaatgaccscggacgcccccacctcmacccccgcgcccgcctccctacaggttccctcccccwactctcgaccagcacttmttcgccctctcwtmagcctacccccacccgmctcccmggcgcccaccctcmccttkccgtcsgttgaggcactcctttcctccccgattcggccstcagacattttcttccattccgggaccgcgccttcatagcactgtattacttctcatccgcctcgtccgcgccgctacagccgccaacactcccgaaaccaccacactgmattcttgcaccttcacctgctcccgactgccsttcttcgagaggccttccgkggcgagsctggctggaggtcctcgcgcggtcaacttcatgctctccgcttgckgatacggagagcgtgtackggacgagagtggggwctcttatgkaawgaagcmctagatgcccacagckccaggacagaatggcagcacacgcatgcccggcgcccctcgccacccgtttccccatcggcacgtgccgcccgcgctatgcgccttgcctcccaagctcaatacggccgcgccatgcgcacatttaccaacccccctctagctgacctcaacgacccggccacgatggagcggctccaagcccttcaccccactcctaccgtgcccgtcgtgcccctgccaccctccgcacagcctcgaccacccgaagtcaccgmggaggcggtcwtgcgtgcggttcgtcgcctcaatccgaactcggcggccggccctgatcgcatgtccccgaaattgcttcacctcctggctcacactcccataagcccagaagcgggcgtcaccggtctctckgcgctaaccaacctcgtcagccgcctggctcgcggctccctcccaccctgtacgatcccactggccagtgcggcgacacttctkccgttgcagccccgaccgggaaaaatacgcccgatcgctattgggcaagccctwcgccggcttgtcacaaaaktmcttcttcctgccgccatcgacgactgtcgggaccaccttgctcccgaacaamtggcmaacggcataccmaacggcattgacgctatcgtacacgacgcacgcatgctagtacgacgccacggtaacgacccacactacktaatggtgtctattgacgcttccaatgcgttcaataatttctcacgscaacaagtcctcgaccagctgcccactcgagcaccatcgctctcacgatatttggatatggtgtacgcacgcgccccctcccccctcgtcttgccttcatscccgcctaccatactccacagccgggamggatcacaacaaggggaccctgcaagcatgctccttttctcgcttgccctccagccgctcacgcgcctcatttcacgtgagtgtgamctwktaatgaaccgctggtatgcggacgacggaactatcattggacggattgacgaagttkccaaagcccttgatatcatcactaaagaggggcccaggttccaattcttcctcaacccttcgaagacacgcgtcttctggccaagcaggcagcmagacctcctcagcccgctcatgacagtgggtcctctgcgmgtcatcgatgaaggcggtgtggmtctgctcggcgcccccatmgggtcaccaagctwtatggcacagtacattcgggaaaawttgaacacttgcaaaaccgcmctcgcccatctcgaccatatccccgaggcccgcatgcgctttcacctgcatcgggtgtctgcttctgcatgccgcttgcagcacctcttccggttggtccccccggatttcgcgwtgccgtttgcacaacaattcgaccgtgaccaactcgmagcctatgmgcgctttaatagtgtgactatgtcgccaagaatcgtgcccaaatacggctgcstttttcmcacggwggccacggcctcacctcattggcatctaccatacacgcctcwtacgctgctagcctcatcgataccgctccagcacggctacaaggtccccactttcccgccgtctctcagtatcagcgttttgcacgaggcccgttgcgggtcgttcttcgaaatttaccttcattcgtkcaacccgcacacttctcgatgacggaawcggacctcggmtgccttgaaccakctgcgctactggcgcgacctgaacgcatacacacctttctacttcaggcgcaatacagtgcagcagcwagctcgtactggcaaawacccctctgggagtccttccccaaccctggtgatcacagcgcagcctcgctacgcaaacgagtacgctacaactccctgcttgccccwggggccaccagttttctcactgcacacccsgccgccacctctcgggtccacaacgcaacttggtccacgatgttacgtcggcacctcgacgcccccgtgaccaacgattccatatcgccgttgcgatgtkctcactgctccaagcctatggatgcccgcggcgaccacgcgwccattkgcagccacgggtttggtacgttgcaccggcataacaccgtcaggaacgtcctcgccmggcagttattccgmgtcgctggcctcgcctactcgctcgaagtaccctttctgattcccaacaccgccgcccgtcccgcagatattctcgtccaaccacctcctccagcccctggcctacctcctgacmaacccacagcctatgatgtcacgatttgtagcccttttcgccgcggaatgttataccatgccgcccgtcaccgcggcggagccgccgacgccgcatctgtaaggaagmgcaaagccctcgagcgcactatccgcmacgctctccttatcgaggacgacaatcstccgccgcctcttgactggcactttcaaccgctttccttcgacgcwctgggmgccccctctcagtctactgtacacgttatcgaagatcacgctaagctcatggccctccgcaactcgtgcacmattgcaactgccaaatcacgcatccaacaacgcctcagctttgctatatggtccagtgctgccgccgctatcctctctcgcctaccgacacacgccgcggacatctcatacccgatagaagtataattcaccttcatatctgctagtgtctctgtaagcgcacccctcatgcattgataaaattacccccca

SEQ ID NO: 1032 - DNA, 5481 bp, Acanthamoeba castellanii
taaccctaaccctctccctcggcccctctaccctaaagcgccctaatcgaccggcgacgccctaatcgctaccctctacgccctaatcgactttggcgccaaagcgactttccccggccgattttcttcctgcctttttcttttctctccaagcgacgcgccttttactttgccgccgttctgttttttcttttctctttgcacttcgcttctacttcacacctcctcctcctccttctcgacccgcgcggcctcgagcgacttgctgcagcggctcccggcctcccccacgcggcctgctactcccgctttctagacgcccccggtcttgctctcagtctcccgcatcgaagcggtagtcggggtacgtgctcaagtgactcaagcctcttttcagcctcggcgctctctcaatccgcctcagtcttagcctttcaagttgctcgattacgctctcgaatcgctctctctctcagtctcagtctcagtctcaatctcgatcttgccttcgccttcgtctcgacgccttgctctcgwaatcgctgccactacgtgccagctttttcgtgccttgtcttcgtgtcgacccggaccgtttgcaagccctcgccttcgtaccccgctctcgtagccgttctcatcgctgaagcgttctacgcgctggcagcaagcctcggccctagcttgtagcgccgccggtggccgctcgccaacatggctacgacgaccatctcacgatccccttcgtcttcttcttcttcttcttccgctcgctcgcgggcgtcagcttccacgtccgcctcagttgcgtcgataccccgcctcttccgcgatggccgcttccactgccctctcgcccactgtcagacccgcacgtccacatggcaggacctctccgcgcacctcacacgcatgcacgacggtgacgtgccccgtgacgtcgccgccgcctgcggcatcgtgcagtgcctacacgagggctgccgcaagtggtttcgcggagctgcaggacttgcctctcataggggcaaggcccgtcacgccccgccaccagccccccgcgccgccctcgccgtcgccgccgtgccccgcgcggattctcgcggtaggaccccagccccgaccccctcggtagccccgcccwacgccggtcctccgccgcgagctgcgccacgcgccgcccccagcccactgccgtgcccgcctgcgctcccgcacccgcccccctctgcctctcctcccacctccagcgtgacgtccccgtgctccccgcccacgaccccgccgtcgcagccttcgcccgacctgttctcgggtttcgcgaacgcgcctaccacgccatcgccgccctccacgccgwcwtcgtcgccagcaggctcgcccatcccggctgccagacgcttcgtcctgcctgtggccacgccctacccggcccccgcgccgcgtgctaacaggcccaagctgtcgccggtcgcgcgccccttcgtccctaaggcgcgagccggagcgatacctgaggcgtcctcacctgtgacgcctcaggaccgcgccgtctcacgccgcgaagacgccgccgccgccccttcgtccgcgccgggcctcggcctagcagacgaacacgaggacgatgacacgtacggcggtgacacaatcgcgctcactgccccccacgcgccccgtgagacccgcgcccccttcgagttcgaggcgtgtttcctcgaggaggaagccccagccaccgccggcgacctcccgccttacgcgcgcgccttcctcgcttgcccgtcagcccgtctccaggagatcccgcgccgcctcaagtccgcgtggcaggccgccgccaagaccatcgcggaagccgcgctggattgccacaccgcgggcgacacgcagggctacaacgcccacttgcggctcttcatcgagctgccggcccgcgggctggcagtgcccaccaactgtcgaggcgccgcccgcaccaagcttcaacgagagcgcctgctcgacatcgccgccggaaggatcccggccatcccggacccgccgtgcgacgccccgggcgccgacgacgccctacgcggtttccccgtatcggggacgacagccggcgacgtcagcaacgacgacgacagcggaggtgtgcacgatcggcccgcggccaccgccagcgcccggcaagccaaacggctagtggagcaagggctctcctcccgagccctccgtgcccttgaacggggcgagcccgcggtcgcctcggcagacaccctcgggcgtctcgaggcgctccacccgcctaaccccaccgacagaggactatggcccggcgccccgaaggccgcgatcccgcgggtcaccgccaagcacctggcccaagtggccaaagagctcccgcgcggtagtgcgccgggtccctcgggctggacgttcgagctcgtgcaggcggccatcgaccgccaacccacgggcacggttgccgcgttcctcatcgacatggcgcagagagccctccggggcaccctacactggcggggattgctcaccgccagccgccttgtcgcgctgaagaagcccgacggcggtgtacgacccatcgccgtaggcgaggccctctatcgcgtcatcggccgccttgttctcaaggccgacagggtgatgtcgagcgccgacgccacgcaatatgtcgggcggcaccagtatggcgtggcctaccccggtggggttgaggccccggtccacgccgtccgcgaactgcacgacagcggccagctccgagcggtcgtctcgctcgactggcgtaacgcgttcaactcgctcgaccgcgtgcacacggccctgctcatcgccgaccgcgcacccgctctcgcgcgactctacgagtggtcctaccgtgaggactcagtcctcgtgctgccgcgcgcgttcgaaaaggcggggctgccggcctccctgctctcccaggccggcgtgcgccagggcgacgtcctgggacccctcttcttcgccatcggcgctgccccggtcctcgacgagatcgacgccataccgtacgtgacgccgcgagcgtacctcgacgacatcttcgtcacgataccccacggtgtcacggacgccgcgaccaaggccgccgtcgctgccaccttcgctacggcggaacgcgaaggcgcggccgctggcttgcggctcaaccgctgcaagtcggcggtgtgggccgcggacgcagaagccctccttcccccccacgccgctggcgcgcgggaggacgtcgagagctgcgcaccagtgcgcgagggcctcaaaatcctcggcgcgcccgtgggctcgcccgccttcgtcgccaagtcgctcgacggcatcatcaagcgcgccatcggcacactcgacctcgtcgctgacgccgagctaccgctgcagcacaagctggtgctgctacggcagtgcgtggcccagatacccacgttctgggcccgcgccgtgcccgacgcaggcccggccctcgccgtctgggatacagcgctcctcaggcgcacgggcgcgctggtcggacttgacgtgcgggacgggtccctgcaagccgacatcgcgcgcctgcctgtccgcctgggcggtctcggcctccgttcaatgaaggacacggcgccccgggccttcgtggcctcgatcctgttcgccgccgcgctcgccaacacgcgccgatccgagctcacgtgcagcgccagtacggcccgacgcctcagagccgccctgcccgagctggcacgcaccgacgcgtgcaacgacgaagccgcctggcggcggtccatcgccaggggagtcttccccgacgtggacaagctgggcaccacacaactgcagcgcgtcctccaggggatggcggactccaagtccgcccatcggacccgccgccaagtgcccttcctcttcgccgccgtgttcgaggacgccgccacgccgggatccggtgcctggctggccgccataccctccgacccgaccctcgtcttgccagacgccgaactggccgaagccgtgcgcattaagttgctcacgacgacggccaatgcggccggcgtctgtccggcatgccacaagaccggcatcgacccgtcccacgcgtacacgtgcgtttcgctatcccatttgcgcacagcacgccacgacgtggtcgttcgccgagtcgagctcgcctgcaagaccgagaagccggtccgcgaacacgtgctcgccatcccccccgtcgcgcccaccgacaacaacaacaacggcgacgaggacggcagcccagtcaccaccgccgacgacaacgcagacggccacgcggtcgcgaccaaacgtcgccccgagacccgcgcttcagccagagccgccgccgccgccgccaccgccgccgccgccgccgcaatcatcaacgacaacagcctcctgagcgacgacgacgacgacgacgaccatgacgacaactgccacggagaggaaagaggagagggagaaaggaacgtcacgtgccccggccactacaccgccacacccttcgccgcggacgacacgctcgacaacagcgacgaggacaacgaggacaacgctcacgaagacgatgacgaagacggtaaagatgacaacgacgacgacgtctacaacaactgcaacagcagcagcagcgacggggatgaaggcggtgacgacctggactacgagtacagtgaccagagcgtcactcgaagcgtcgacgccgcgacgggagagagccccaaccccgagcgccctaccacgcccacccgcgcactactacgcgcggacctgtggctacccgccacctccaccgcggtggacgtgatggtcgcggccgcctgccgtcggtcacgcgccaaggccttcgaccgagccgtcagccgcaaggccgcgaaatacggccctgcggtagccgacggctcgatcgccaaggtggtgccgttcgtcgtgtcgccctttggcgtactctcgaggccggccaaggccttcctcaagcgcgccatgggcgacacgacggcggccaaacaggccaaggcgcgtctgcgcctcgccgtggccgccgtccgaggcacggcccgcctctcctacgcctggggcgcctgcgccgccctcatcgtcggcggcaactaagccgcgcgacgaggacggccaggacgaccaggacgacggcgacggcgaccacctagcaccgcacgcgccacgacatattgtcgcgcgctgtacaggcggctaggtcgagcccagccgaccgttctgagcctcagtcggcttgagcccccggcttcccaaggcctaccggggcggctctttttcgccctggtttttgccggcctgttttttctctcccccttttccccccttttccatttgtacttagtttttccttcggccgcggcagcttgttgcccggcatagtgttaatatgtttaaaaaacgtgtaaataaataactgtttaaccctaaccctaaccctaa

SEQ ID NO: 1033 - DNA, 4121 bp, Fragilariopsis cylindrus
atcaatctaatactgaaggcaataccaaactcaacccgaaatcaaaatcgttagaatcaatatacgacccccgctgctgtacatgtccagccggatctcgttgtaaagaagattgcagctgtaaaaaagttggacttctttgttcttcctgtgaagaagttgattgtggctgttcaaattcttttcataataaagaattaatggctccacttccttggaatgctgcgacatcttcaccaccgtcacctgtcccattaactaacgataagaaaaaggattctactctacctactgcaacatcaaaaaatttatccaaaaataataataataaaaataataatactaataggattaataatattaaaaataatgataatacaaatgatggttctaataagataaatttgaaactgcccccggcagctgttaaaatcacaaatccttataagaacaaaaagaagaacaagaagaagaataacgctggaaagtcgaaccccaaaacaaaccaaaatccaaattcaagtccactttcggataatgatgatgatgatactgatagctcaaacatcaccattaatagacgactaaaatttggtactgatgatttagcacctccaaacccaccgtcaaatactaatactattggtactgctactgctgccaccgctgccactgctacaactacggcaaccgcagcgactgctactactgctaccaacactactactactactactactactaataacactactggagacaatcttgcaagtaatattaataataataataataataataatagtggcagtaacaatagcaacaccaataatattaacaataccgatggcaatggtagtaataatcgcccacctccccgtgtttacacagtcgatccacgaagcgaccttcccggtgcagaaatctctgctgcaaataaaatgttagatgaagtatatggagaccatgtccatgacaaccccggctcccatctcagcggacttattagcagctctcaagatcaactctggcagggttactttcgtcgccttatacctcacaaccaatctctctatgactgccctaagggaaaactgggtaaggatataacgaatgaatattcaaacttatttgaggcaatcatgaatggcaagtgtaatatggagaagctactcgtgtttccagtagtggttctacaacggagacacggagtgactaagaatgccgacgttaaacgccgtcttcttagccgactcaccgcttggaaggaaggcaaattcaagtatcttgttgaagacacacatcgagatcttattgccaaacaatccaaagcaagaggagatacaacccccgcgcacagagctaaagtttactcaagtaaactcatgcgtggacatctccaatcagccgtcaactacatcactgaccgcgaaggagggggcatcctttatccttatgacgtcgatgagaaatcaggccatactgtatcaagagtgctacaggataagcatcccagcatgcgtgatcctggtcccacagccatgcctgcctacgagtccgtcccggaacttccaacacttgaaattacagctgatacagttgagatagtcgctggaaagctcagtggtggtgcaggtctgagtggagttgattcaatacaactcaagcacctcctcctccatcacggtcaagcaagccaacgactgcgcaatgtttgtgcaaaatttggtagatggcttgccaacgagcaccccccctgggcctcgtaccgtgccatgctagcaaataggcttattgcgctagacaaaatgcccggaattcgaccagtcggtataggtgatacatggcgtcgtttcttcgccaaacttgttctagcagtctctatgtcttatgctactgactgttgtgggtcagaccagctctgtgccggactaagagccggagttgatggtgccatacatggactatcggctatgtggagggagatggaatctgaggaaaacacaggtttcgtacttattgacgcagacaatgcattcaatgaggtctcacgcatcaacatgttatggacgatccgccacgaatggcctgctggagctcgattcgccttcaactgctatcggcaccacagcctactagtggtacggaatccaggcgggaaacccttcactttcttttctaaagaaggtgtcacacagggcgacccatttgcgatgatagcatatggtgtcgctctcctaccactcatccgcaaactgaaagaattaaatgtattattagttcaatcttggtatgcagatgatgctagcgcagctggcaaatttgatgaaatactacgcctttttcaagatttattacgaatgggacctgattttgggtactttcctaatgcatctaagagtatcctcatcacccatcccgacaatgtggttgcagctcaccacttcttcaacgagacccatggcctaggtttcaagatcagcacaggaagtcgtttcctgggtggtttcattggagataccacaagtcgagatgaatacgtatcaacaaaaatcgccgactggatccacggcaccaaggagctagcagcagtagcaagattgaagtatccacacgcagcttacacaggcattaccaagtgtttgcagcacaagtggagttttactcaacgtgttattcctggcattgatgacctcttccaaccactggaggatgaactcaccaataatttgctccccgccctatttggagaccccccatccactatggatgacaagctcagacttttgaccgctctgccagtcaaacatgctgggcttgctctcccgaatccagttacctcctccgcaaccaactacaagaatagcactcttatgagttctcatcttctgttggctgttcaaggcaagatcaacttcagtttacaggaccacagagatacctgtcaatcctctctctccgcgtcccgagagctccgacaaaccgaaaatgattcttcattgaccaacctccttgcagctctccctccagctgctgcaggtcaaccaagcacaacaagagcaatcaagcgtgctggggaaaccggtctttggcttactactatccctaatcacatcaacggtaacattctcggatgtgacgaatttattgatgctattcgattgagataccaaaaagtgccacacaatctccctgccaaatgtgatggctgtggctctgcatttgatgtagggcacgcgctccaatgcaaatccgggggcctaatcattagacgtcatgatgaactcaatcttgagcttgcatctttagcaaagatggccttgagagaatctgcaatacgtgctgaacctgaaatcaaccccagcgcctctattatggattctcccaccaccatcacagccatcgacacaaacggagaccgaggagatttgttgatcaagggcttttgggacaatggaatggacgctatcatcgatgtcagaataacagacacagatgccaaatcctatcgaacaagagacccaaaaaaagtcctacagtcacaagagaaggagaaaaagaagaaatacctcgatcaatgtctactccaacgtcgagcctttaccccttttgttgtctctgtggacggcctgattggttacgaggccagcaatgtgctaaagcaattatcaaaacgtttagcagataaatggaataagccttattcagttacatgtggaatagtccgctcacgtatcagcattgcatgtgcgcgagcttccaatcaatgtctgagaggttctcgaataccattcaaaacaatgagcagacaaattcaatgggaggacggtgcaggcgccggcctctatagaattgtccgctagcaccaccatctattcatatccacacactgaccacctccaccttcacaactccactctcaattcccctgactactaagaaatatttcatggtggttacattggaggtatcccaacaccaagcacaaaatgaacccactaaccctctcatcctatccacggggaccacctttgagcagaacaccattcatattacaacctttagctagattaagataattatttagtacatattttatactattaaaaaaaaaaaaaaaa

SEQ ID NO: 1034 - DNA, 3945 bp, Hydra vulgaris
tttctaatgttacgtgatatgatatggttagttcatggttagtttatgtttatgcttagtttatggaaaatcgtttatttatggcacaatattgtttgctgtttttaaatttatgtaacgtgtgcatttgatgtatattcttgaactttttaatctgaatttttacttggtttaatacgtttattatattcttcgattgagcaatttatcctatcaaagcaatttatccttcgattcgagcaatttatccttcgattcgagcaatttatccttcgattgagcaatttatcctatcaaaattagcatatatactgcaattttcaaataatctacgaaataagttcacttactgaaaatcattaagtaaaagaagaaaggaagaaaaaataaaaataaaaagtagtaaatcctttcataacaataatcattctattattaaatttaaaggaatattttggttttgtactaaatcatgcgttcatatttcaccgaagaagggggctgctatatttttgtttgaagttgtttatcttaaaactttaaacttgtgttcaaccaaccgtaaacattagttcgctgttcgctcaaattatctacaatataaaatttatcaatcttttttcgttacggtaaacaataaacaataaaataactatagttattttattgtttaccgcatattgtttaactatagttaaacaaagtatttgtttatggaacattaccagtatctcttgttaaggtaaacaacaaaacatagacggcatctctttttaaggtaattaagtatacggctaataataaaaatatacagctaataataaaatcttcaatgaacatggtttctatatgcaaaagatgtgatcgtagctttactacccttaagggactaaatattcataaaggtcaatgtaagatctttgtttccaatacaaataaacaaataaacaatgtagttaacaatgaattaacaacaccgaataaaaacaaggtggaaattaatacgatattaaactgcgatgagatatctgtagaacactattcaaccaacacaccttacttacccaaaataaatatttgtgaatctattatagatcccaacgactatctatggggtcatatgccgtttagcttccttctcaaccatgtcaacacaatatacgatgaaatagtattttaccataaaaacctttttaaagtgccatcaggaaaaggtggtaaaatgtttatagaagaactgaccttttggctaaaacagtttaataatcgaaccaaattgaatggaatagccatgaaatgtttcatgatagtcccttccctaatgttacagaagccctcaatacggtccaaagccaaagaacatgcagaatgtttagtaagacgaattacattatggagaaacgggaactttagtgaattgatgcgggaaattagatatattcagagcaaaattaacacctcaaaaaagaaaaggacatttgaggatatctcaaggatattcgcaaaactaatgatggaaggtaaagttgctgccgcactgaaggttttagatagagagtcatctggcatcttgcaatgctcggaaagtgtattgaaagaattgaaaagtaaacacccagacgaaactcctgtacaagataattgtttactatacggcccgttacaaaacactccagaatgtttattcgattcaattgatgagataagtatatttaactcagctttacagactaaaggatctgcaggtccttctggaatggatgcagatctttaccgtcgagtcctatgctcaaaatgttttggaccctcttgtaagactctacgagaagaaatagcaacatttacaaaaaatattgcaacaaaatcctaccaaccggatatagttcaaccctacattgcatgtcgactaattcccttagacaaaaatcccgggattcgccccataggaattggggaagtgttacgtaggattgtaggtaaaaccattagccaccattgtcaaaaagaaatcaaagaggcagctggaccactacaaacttgcgcaggacacggtgcaggagcagaagctgcaatacatgctatgcaaaagatatttcatcaggaagatacagatggtgttttgttaatcgatgctaggaacgcgtttaactgcctaaaccgttctgttgcactacataatatacagataacttgcccaatcttagctatgtatttagtcaacacttaccgtaaaccggcaaaattattcatctacggtggagaaactattttttcgaaagaaggcacaacgcagggcgatcccctcgccatgccatggtactcacttagcactgtgacaatcataaatacattgaaactagtaattcctgatgtaaaacaagtatggttagccgatgatgctaccgctgcaggaaaattacagtctttaaaaaagtggtataaatgcctagaggatgtcggtggtttgtatggttattatgtaaatcagtcaaaatgctggctaatagtaaaatctgataaccaagctgaagaagctaaacttatatttggcaactccataaatataactactcagggaaaaaggcacttaggagctgcacttggttcggaagcatacaaaaaagtgtattgcgaggatttagtaagtaaatggtctaaagaacttaacaatctctgcgaaatcgccaccacgcaaccacaagctgcttattcagcttttattaaagggtacagatctaaattcacttacttcttacgcacaattgaagcttttgaaaatttcgtaacaccagtggaaaaaattttatcagaaaaattattacctgtattgtttggaactgattgttctataatcaaagaaaatagggatttattggcgctaaatccatcggaaggaggacttggaatttgtaacttaataactgaggccaaggaacagcatactgcctctaagaaaataactaacttgcacataaaatcaatactcgatcagtcagatgttatgaaagaaaaagatgatttcgggaaaacattttcagaaataaaaacaaaaacaaatatggataaatctaaaaaaaaaaaagaagaggttaaaaaaatacatgcaggacttccagaaaaccttaaacttctggttgaacaggcctgtgacaaaggtgccagcagctggttaaacaccttaccaattaaagaacaacatctagatctgaataaggaagagtttaaggacgcacttagattgagatataatgtgccacttgccaatttaccatcctactgtgcttgtggagaaaaatttgacgagctacacgcaatgtcatgcaaaaaaggtggctttgtttgtaacagacatgataacatcagagatttattaactgtttgcctaaataaagtttgtactgatgttcaagcggagccgcatttaattccattgacaaatgaaaaatttaatttcaaaactgccaataccaacgacgaagctagattggatataaaagcaaaagggttttggagaaaaggagaaactgcattttttgatgttagagtaacgcacgtaaactccaaatcctccaaaaaacaaccaacaaaacacatattccgtaggcatgaagatgcaaaaaaacgtgagtatttagaacgagttctagaggttgaacacgggacatttaccccattaatttttggtacgaatggtgggtttggagacgaatgcaaacgcttcacggcactactcgcacaaaaactgtccttaaaaatgggtgagcggtacggagctgttataaattggctaaggacacgtctttccatggagattactagagcctccctactctgcttaagagggtcacgaaccccatttaggcattataacactgacgatgttggcctggaaaatgtgcaatgtggacttatttaacttgtatttttaaattgttttattagttt

SEQ ID NO: 1035 - DNA, 3489 bp, Lactuca sativa
acattaaattagagaggttgatgtttcaatggaagaagatgaaattccaagaagctatttttgttgcccaccaagtgtttgataaaatgtccaaactaatttttctcttgttgcagctttattgttcaagataatgtagtttgcttagtttgagcgttccttgtgcacaccaacagtgtgttggtgtgccatttcctttccttcctttttaactattgcttcatagcttaagcttcatctcgaggcttgttctcttgtatggcttcttcttctacaagttcgagtgatatttgtctgtgcccgttcagaagcttccattgttgcccaaatggtgaagtgggaagtaaggggattgkccgtatgatttcacacatcaaaaggcatcatctacttactgaagatcgtaaatgtgttttacgtgaagctctttctagtgatgttggtttatttatggcggtggaagaaactttgaaggcctttggtcaatggatgtgtgggaagtgtatgactttgcatgctcttagccgttattgtcatcacccggatggtcgtgtgagktttgttacaggggctgacggctcgagtcgttacattgtcggtattctaaagccgtctactaaagagtcggtgacaaatgctcttggaggtttggtttttgatgttgggctccttgatcgtgtttttaaagagcctatcactactgtcaagagtatcccccatagttgtcgccttgctttctctcaggctttgaaaactgctctttacaaggtgattgcccaacctggctcggttgatgcatggatttgtttgttacttcttcctcgctgcacactgcaggtgtttaggcccaaaaatagacaagaatgtaggtctgggaatagaaaatccttacaacaaagctccatcctgaagtccttggatacatgggggaaagaggatggtatcaggaagttagttcaaaatatgttagacaatcccgaggttggggccatgggacagggtggaggcatccttcagaaggagtctacatcaagtaacaccaacatcaggcagtgtctccgtaaggttgcagatggkcattttaccgcagcagtgaaagtgttatgctcatcgggtgttgcgccatataatggtgatactattaaagctttggaggacaaacaccctttcaggccacccccatccatgccgagccccataatttctgaacctccccttgtagcagactttgactgtgtatttggttgcatcaaatccttccctaaaggaacttcwtgcgggagagatggcttgagggctcaacacwtactagatgccctttgtggagaagggtctgctatagccacagatctcatacgtgctatcacttcagtggttaatttatggttagcgggaagatgtccgaccattttggcagagtttgttgcatccgctcctctcacgcctctgattaaacctgacaacgggatccgtccaattgcagtaggcactatatggagacgtctggtttccaaggttgccatgaaaggtgtgggtaaagaaatggccaagtaccttaatgattttcagttcggggttggtgtgtccgggggtgctgaggttgtgttacacagtgccaatagggtgttgagtgaacaccacgctgatgggtctcttgcaatgctgacagtggatttctcgaatgcctttaacctggtggatagatcagccttgctccacgaggttaagaggatgtgcccttctatttctttgtgggtgaatttcttgtacgggcaagcagcgagactttatataggagaccaacatatatggtctgccactggggtgcagcaaggcgaccccttgggccctcttctttttgccctcgttttgcacccgcttgtgcacaagattagagacaattgtaagctccttctccatgcttggtatctagatgatgggactgtcattggggattcagaggaggtggctagagtgttgaacattattcgggtgaatggtccaggcttgggtcttgagttgaacatcaagaaaacggagattttttggccctcctgtgatggtaggaagcttcgtgccgatttattcccaacggatatagggagaccttctttgggggtgaagctccttgggggggctgttagcagagacgcagggtttattagcgggctggccatgaagagagcggtcaatgctgttgatttgatgggtcttcttccacaactatgtgacccgcagagtgagctccttttgcttcgatcatgtatgggcattgcaaaacttttctttggtttaaggacatgccagccggtgcacatagaagaggcagctttgttctttgacaaaggattgcgcaggtctatcgaggatatggtggtatgtggaggccccttctttggagacatccagtggcgtctggcttccttacctattcgtttcggtggtttgggtttgtactcggcatacgaggtttcctcctacgcatttgtagcctcgagggcccaatcttgggcattacaagaccacatcttacgtgacagtggcatatgtggtatggactctgattacctatgtgctatgactcgtcttcgcgatacgattccgggattcgactgtagcggtttcactaataaggacaccccccctaaatcccaaaaagcattggcgtgtgccctttttagcaaaatcgtcaaagatatggaagtcgacttcgacatgactgttagacagaaagcagtttttgagtgtcttcgggcacctcatgctcaggattttctgctaactatccctattgatggccttggccagcatatgtctcctgtggagtaccgaactatccttcgttaccgcctcatgattcctctattcccaattgacgagatatgcccagtttgccgcaaggcatgtttggatacctttggggaacatgcggttcattgtagagagctccctggtttcaagtacagacatgatgtggttagggatgttctctttgatgcttgtcggcgtgctggtatttctgcgaagaaagaagcgccagtgaactttttgacggacccgcaggatggaagatccacacttagaccggctgacattttggtctttggatgggtaggagggaagcacgcgtgtgtggatcttactggggtctctcctctcgtcggtttgaggagcgggggtttcacagcagggcatgccgctttgaaagccgctgcgtgcaaagtggcaaagcacgagaatgcatgtatagaaaatcaacatgtgtttgtaccttttgcatttgatacatttggttttctcgcaccagaggcggtggagctcctcaacagagtccaacgggtcatgcattctaatgtcatatctcctagatccacagatgttgttttcaaaagaattagttttgccatccagaaagggctagcggcgcagcttgttgcccgtttgccttccatcgatatgtattgaactatattttatatattaaaaaaa

SEQ ID NO: 1036 - DNA, 5033 bp, Monosiga brevicollis
catcttggcgtgaaccacgttgtcagacaaaatctgcaaccccgctctttgcggcccgcgttttggcggcgccctcgctcccaccgtgtccgctcgcttgctcgcttgcttgccccgcggacatggccactgagtccggcggcgaggattcttggacccaggtccgcggtgctaaacgcccgagtgccgaatcacctccaagcaacaccaccacctcgccttcccaaactcatcgttctgcaaaacacacaaaacatggcagcgctcgccacgaccgtaaccatgttttccctgaccccatgaccaccccgcttcgccctcacgcccgccactctgtccctaccgcccgtgcctcgtctcatgtgccctcgacgtcccccgctgccggtgcgaccgagtcttcggcacgtgccgtcgtgcccgcggccgagccagtgaccaggacgtcaaacggcggcggggagcaacatcccatcatcggaaacacttccaatgcttctccccgcacccctcgcacgccatccagccctcgctcctttgctcaagttgctgcggcaatgcctgccgccgccactgccacatcttcggcccctatgaccgaggatttgtcagcatcggtgccctctgagccaaatggcagcggggagcaacaaccctcgcccgagtccacagggcagacacatcattcgattcctaacacaccatcggattttttgaccatgtcttcggatgaaagcgactcccctcctcgctccaccgcactccgcgcgcccacccctatcgcccctcccgcgcatgatggtgacggtgacacaaacggcagtgccacgcctgagccattggtgcaatcacctacacccgctcaaatggtgctgccatatccatcgggtacacaacaaacccattccgatccctctccgccctctgcttcaccccctgccactaccattttgcccgctgccatttcacatcctgtcgaacacagtgagcatgcaaactcagccccacttggcgaagtcagtgagagtgaaacacacaatacagcgggcgaacacagtgagagtgagcaagatgttcttctcagcgatcccgctccgcccatcgctgccaacgtgctggatgcccagcgcaaggtcctgctgaagacatctggccacaggcaactcctcgcctgcccatttgggctttgcaaatgcaaggggccccgccttgaccgcaaagcctgggtcaatcatgtactacgcgagcacccctacgacgagcaagccactgatctggtcaagcaggtgatggaggccaaattggtcgcccagtgcaacaagtgtcacctcttcttcgaagctgctggtatcagtcaacaccgctcccgatgtggtgccaatctgaagcgagcgaccgaggcgttgtttcatgcggctggacacgacctgcttgagattatgcgtggcgcttggccccaacagtgtgtagggtctcgcatcagtgtctgcgagctgctcaagctcgcccggcatccactgatgcagcgcagccgctacccatccaacgccaccgagaccaagctgatggctgccaccctgagccagctgtattggtctgccgtccactcggactataccgctgaagagcgagagatgtgctgggctttgattttggccttgcctagcatgttgttgtctgctccctcgaccgcactgtctacgattgacctgcgcaatatgtttcacgatcgtctccgttggcttgtgacggggcaactaggtcgggtcgtggacgccatgcgcaaggcagtcgcacgcaagcagagccgtcgaggacagctgaacgccggcgcgggcgcccacccgaacgacgcagtcgaccagagcctcaggtcgctcgtccgcgacccggacctggcggacgaagcctgggcaaaccacgtcacgaaccgtctgaaccgaggtcagattgccaaagcatttgatgccgacaaggctcgtgccgtgattggtaattctgaggttcaggccgtgcgcgacctcttggtaccgcccgggctgaccccgtacattgcttcgacacccgcctccacgtctacactggcaccagccacggctgtgagctccccaaccgtgtccttcaccaagggtgagctccccaaggcgttggcggccaccaagggtgtcaccgacccctatggttggtctggtgagcttcttgcctccatctaccgcatcaaggagcacttcagtcaagtcttgggcccacgccagggttctaccagcgacccgactgctccttctgatggagacgcgcctcagggccccaccaccgccactggaggtcctcaggttgccttgaacaagatctttcaccacattgccaacaacaccgtgcccgagtcgattcgacatgccctttgctccatcaactacactatcctggagaaggccaatggcaagtttcgacccgtgggcacggattccatcttcaacaaggttgtcaaccgcgctctgctcgagcaacagcagccccatattgcccacttgctacaggccagtccagagctggccgtcggagtcaaggacggcatttcagcagcggttggcatggcctttggtgagcttcaagcctgtgagtctaccccgggctggaccatgctctccctcgatttcaagagtgccttcaactacaccgaccgagcacggctgcacgagattgtggccgacaaggtccctggcctcttgcgcgcctttgaacgacactatgctcgacccactacccactgcattgtcgacaagttcttcaaggtgattgacattgatgttggccaaggcattgtgcagggcaacgagctatcgcccttcttctttgccctgtactcctgtgaggtcctgggtctcctcgacgccaccactgactaccgctgcaaggtcatcaagtacctcgacgacattgtactgatgggtcccgcggaggacgtggcggccgacgtggagattgtcaaggctcgtgcagagtctgctggccttcatctgcagcccagtaagagccgcttctacatgcctcgccaccattcggcttccatcactgctatcaagtctgtattgccagatgccgtgcgcgagacggccaacacgggcatgacggtcttgggaacgccgattggccgtcgcgagtggatgaagaagcagctgaacgacaaggcaaagcacattgctggcaagctcaatgacatgctgacgaccggtgtctcgcttcaggccctcctcacggccatgcagtacgtgcctagcctcatcaaccacctctacacgctgcccccaagtctcacgtcgggcttgtccgagctcttgaaccgtgcttgcaaggacacctttgtcaaagccttttttgccaaggtaaacctgtctgcaccggctggagctgaaggtcatgacgttacgctggaacagctccttgaggctcgcctcttcacacgggccaacaccgggggctttggcctgcacgacttggttgagcgcggtccggtggcttatgtctgcaacatggccaagctggccactcgctaccctcgggtctacgatcgacttttggaggatgcatcgagggctgccgactttgaggcccacgtgcagcgagctggcttccagatggccacggtcaaggacgcggcgacccagcgaccagctgagatcattgccctccgctccaaggcggcactggacgacctgatggccaagtgcgcgctggacctgcagcaggcatatctggcctcacgcgagtggggcgtcagcactgtcttgaccatgcggggtcgggacaagttgcgtcgcttgagcgacacgacctttgccattgcggtcgtgtccatgatgggttttggcctccatgaactcatcaacgtcaagccgacggacaagtgcccgctctgcagcagcaagacacctcagccgcgactgacccgcgagcacctgctgacctgccgtcccatcaagcgtcacaacgcccttcgcgacgagatgggccgcctgctcaggtacgccaccctctcccatgtctgggtggaaaagtctggctacaacgccaacggtcagagctgccgcatcgacctgcactgccgcaacccctttcccggcggtgctctgggcccagctctgcccgacctgggcattgacgtgactgtgcgcacagcccaacccccgaccacctcgcaagcctgcatcaaggtgggcgctgcccttcgccgagccgaaaaggagaagcgcgactactacaccggtttcaaccatggaaaaactctgatcgtccctgcggcgatgacgacaaccggtgggttcgcctcctcctttgtggatctgcttggtcagctcgcccgctgcgccgaggcccgtggtgtgtaccagccggggctggatgaggcctttgttcctcggtggaagggtcgctttgcggcgctggtccatcagatgaacgctgaccacatccagcgccactttggcggtgtctgcctgcgctcgtcgtaggtaggcaccgtctcgggggtccctctgtggggatccctgtgtgcacctgtcgctccctaggtggttcctcgttgtgtcttttgatggcttgacttgtatttttgttttaattttgctttaatttttgctgtatttgtgtggtatttttgctgaatttttgtaaggtcctttgtatgatgtctttgtcttctgtggtcggttgttttcctcaatccgacgttgtgtctcgttggatgtgagcgtgccgtggtgttctttgtgtttgtgctgtgatggcttgtagttgtgatgtgtgactgcctttttgggtgtcttgtgtttgaaatggccgtatctctggttatacttggtcgttttgtacgatttttgtttctatgtgcgtgattcttcgcgcttgtacttcttggcatgatagaagccaatgaatgtgtcttgttctcttgtgttgttttgcgtgccgtcgtgattttgatgtcggggttgcacagctttgctttcagctctgaggttcaaacacctaattta

SEQ ID NO: 1037 - DNA, 3776 bp, Hydra vulgaris
aatttaaaaaaaaaaaatcgtttatttatggcataatactgtttgtaatttttgaaaattcgtgcaacaactgcagttaaattgaagagctgaaatttaagatctgagcttttcaatcagagttttttaccctaaaacattaaattttatcataacaaaaatcgttctaatattattaaacttaaagaaattcgttcttatatcaaatcttatttcagtgtttcacagacgaagggttttactagatttttattttttcaacttttgaatttgtttattataaaactgtaaactagtgtgcaaccaaccgtaaaaawtagttagctgttcacccaaaatattattcagtatgaaaatatttaatcttctttattcgcagtaaacaataaaatatctagttaaacaaaatatttcttaataataaaaaacaaaaactttttcttaacaagtacaatgagcagctgcaaagttactatacctcatgtgtgcccttattgtaaagtagaacttaaaacaatatgcggaataaaccgtcacattttaaaatgcaaaaagaatcctttacaaatacccagtctacaaaaaactaatacctctttaacactcgaaccaaatactaaagtaataccctcaattacaaaacaaaacgatattataatagcatccacttcgtctaacaacttagcgtttaatcaaaaaaaggactacacattaacacctacatattctagaaaaacgacacccgtaagcatactgtcttctatgaaaatgacacccataagtataacatcacatatagttcgcagaaaactacctgagcttccttctcaaacaacaaatcatttatttaatgagaattttataaatgttcccttcttgcctgaaataatgaaccatctaccagttccaaataacaatgtcatgtggggagtatactcatatcaacaatttaaattgtttgtggattctacctatgatgagatcgtaaattaccgaagaaatattttcaacattccatctggaaaggcaggtaaagaatttatagaggagctaaccttttggttaagaaagtttaattccacttctagtttaaattcaatcgcgctgaaagttacaatgattttgccgaatcttcttttgcaaaaaccctccgccaaatcaaagtccaaagaacatacattatgtttaactcgtaggattgacctttggaaaaaaggagatactagtttactgttaaaagaagttcgaaatatacaaaaaaaatttgtaaattccaaaaakaaaagatctatggacgatatatctagaatatttgccaaattaattatggaaggcaaaatcactgcagcgctgaaatttttagaaaaagaggcatcatccggcatactaccactatcagacaacacattaaaagaccttaaaagcaaacaccctgaaccctcccgagtagaagattatagcttactgtttggtccgattgatttaatcccaaaatgtttcttcgattgtattgatgagcaactagttatgaaagcagcatttgcaactaaaggatctgctggaccatcaggaatggatgccgatatttatcgccgcatcttatgttctaaaaacttcatcaaagaaggtaaagaactccgaaaagaaattgctaaaatgacacaaaacttactaacagaaacatatgaaccaacatttctagaagctttcactgcttgtcgattaattcctctagataaaaatccaggtattaggccaattggagtaggagaagtattaaggcgtatcataggtaaagtaattagctggagtttcaacagtgagataaaagaggcagccgggccattacaaacatgtgctggacatggggcaggagccgaagcggctgtacatgccatgaaggaaatattcgacaatgtgcaaacagatgcaatacttttgattgacgcaaagaacgcttttaattgtatgaatcgacaagtcgccttacacaacatccagatcatttgtccattaatttcaatttacttaatcaatacttatcgaaatccatcgaggctctttgtggcagggggtaaagaaatatcatcccaagaaggcacaactcaaggtgatccccttgctatgccatggtactcttgtaacaccacgattattatagaacacttacttgtaaattacccacaagttaagcaggtgtggttagcagacgatgctgcagctagtggaagcattgcaaacttacatagctggtatcaacaccttattgatgaaggatgtaaacatggctactatgtaaaccaatctaaatgctggttaattgtaaaatccccctcgttagcagagaatgcaggcatagtatttggtaaatcggtcaacataactacagagggtcaacgacatttgggttcagtaataggttcgcaaaattttaagaacaaatattgcactgagaaagtagcaaaatggttaaccgagttaaaacaactttgtaaagtagcagagacgcaaccacaggccgcttttattgcgtttacaaaaggatttcgttcaaaatttacatatttcctaagaactattccaaaatttgaacaatatctagcgcccgtagacgaaatacttagtcatttgttgttgccaactctttttggaaaagatacgccctttgaggatcacattagaaaactttttacattaactcctcgagatggaggattgggtatacctatactagttgaagaagcgcctcaccagtttttatcatctgttaaattaactaaaaatcttgtacagcaaattatagatcaagataaaattttaaaaacaaaaaactcttccgggaatgttctagaagatcttgaaaaaatattaactactgacagacttaagcatcgcaaagagaaaataattgcagttgattcaatgcaaccagattcaatgttaagaaacatacagcaaacaagaagcgaatgtgctagcacctggttaaacgccttaccactagaaaaccaaggttttgttttaaataaagaagaatttcgagatgcactttgcttacgttataattttgacttgaaaaatatccctcgtatttgtgaatgcggagaacctttcaatgtaactcatgcattgtcgtgtaagaaaggtggcttcatttcaagtcgtcatgataacataagaaatttgttcaccacattgcttaaaagagtgtgcataaatgttcaatccgaaccacacctcataccccttgataatgagaatttttatttccatacagcaaataaaagtaaccaagctcgtttagatattaaagcaaatggtttttggcgaaatggacagacagcattttttgacgtaagagttacgcatgtcaattccatgagcaacaaaaatctagatatagctgctatattcagaaaacacgaaaaggaaaaaaaaagagagtatggcgaacgagttcgtgaagtcgaacatggcagcttgacaccactagtgtttggtacaaatggaggtatgggtaaagaatgtcatcggtttgttagaaggctagcggagaaactagcggaaaaacaaaatgaaaaatactcagttgttatgacatggttaagaacaaagttatcttttgagatacttcgctcaactatcctttgtttaagaggctcaagaacaccctggactaaaaaaaacgattttgaaatcggtgttgattttaagatggatgctctagaagcaagaatctgagctcttataaatttatattatagcattttgtttta

SEQ ID NO: 1038 - DNA, 5034 bp, Magnaporthe oryzae
cccgaacccgaacccaaacccaaacccaaacccaaacccaaacccaaacccaaacccaaacccggagggttcccaagtcgcctaaacccgaagggtttaggatattatttcgtttattagaattggataattatttacccctgttggacaggggggttgcaggggttaaattaaggttttttattatttatgcgccgtttatttgtttacccccccaaatattataaaagcgcgttccatcctcttaggaaaagcgaagcttttccttgtaaaagtcgctagacttttactataaaagtcgctagacttttataccaatcttttaacaaaaagcgtagctttttgttgccaatctattaaaaaaagcggagctttttttaactttttcttttttttttttttttcttttttttttttttttttcttttttttttttttttttttttatatatattattattattattattagcggtggggctatttatgcgctttaatttgtgcggggctatttatgcgctttaatttgtgcggggctattaatgcgctttaactttacaaattttatttatgcgctttaattgctgcgggcctgttaatgcgctttaatttacaaatttcattaatgcgctttaacttttatatttactaatgcgttatttatataattgctattattatcgttgctattattattattgctattattatcgttattattattgcaattttattatataaaccctcgtttgtccctcgatttatcccgtttcttttccatcccatcgcgcgttttcgtaagctttggttttcgtaggatttgctttcgtaggctttgctttcgtaggctttcgtcagcttttacctgcttttattttttctttttctttttattccccccccttttttttacctggtttattagcggtttacctgcttttattacctggttcccctttacctgttttattagcggtttacctgcttttattacctggttcccctttacctactttataagcggtttacctgcttttattacctggttcccctttacctgttttattagcggtttacctgcttttattacctggttcccctttacctgttttattagcggtttaccagcttttattacctggttcccctttacctactttattagcggtttacccgtttctattagtgggcatttatttcccgtttttattagcagttaaatttacccttttaaggttatttacctgcttttattcacagggcacccctgtttttactagcagttaaatttacctttttaaggttatttacctgcttttattcacagggcacccctgtttttaccagcagttaaatttacctttttaaggttatttacctgcttttattaacaaccctttattttttcctattaacgggtatttatttacctgttttattggaattcacccgttggacggcatggtttgcccaacctgtaacggcgtttacgccgattacaacgaccatatccggaaaaaacacccggacgaacgttataccgccctccaactccaaccattgggtttaaccccctgccctatatgcaaaaccgcttgcaaaaacgatttgggcgttaaaacccacctatccaaaatccacaaaatatccggtgcatcgaaaatttcaacccaaccgcgtatacgaacggaaaatacggataataccaattcggtccccacgtcgtcgtttaaccctgtccttcccgaaatccaaacgttaaccccggggttaaataacagccgttgggccgataaccccagaaaacgacgggccgataccccctccccaacacggggtcggaatacacgcccacgtcgattttcatatacggatatcgatttaacaaacgacgaaccggcggataaccccagggctaataaccccagggttaataaccccagggttaataacgaacccccctccagcccaaattcgttaccttcgatttccgaatttcacacccctgggaccctacccctaaccaattcgaatatatcgttaaaagaccagcacgacaaaattaccggccctatattgcaaaaaccgttaatccaaaaattaatcgaatattcgaaaatcccaatcccagaacaccacctccacgccaggcaggctaaaatttttgctgacgccgcaaatcgaatcgccaaaaattttatacaaagcccaacggagaaaacattatttaatttacttatattaccccgcatattcggtatcgggttaataaacggaaaagtaactaaaataatgcaaaacttcccatcccaaataccccctattccaaaaattgattttccatccgaaaaaaccgattccgacccggttttaaacgccaaaaaattattggaaaaagggtatattggccgtgcggcaaaggctattatcgatccaacccccgttgccccagaaaccccggaatcgttaaatattttacgggaaaaacaccctattggccaaaataacccgtttaatacaaaatcccaaccaatatcaggcaggcaaattaccgaaaaagctattttattagctatttcgtctattggccgggaaaaagctccgggccttagcgggtggacgagatcgttattagatgcagccattaaaatacctacccaaaacgacgtaattccggctttacgactcttaacggatatgattcgccagggtaccgcaccgggtagggaattattatgcgcttcgcgtttaatagggctatccaaacccgacggcggcgtacgcccaatagccgttggggacctattatataaaatagcctttaaagctattttaaataccctatggtccccaaactgtttattaccttaccaattaggtgtaaatagtataggtggcgtcgaacccgctatttttaccctcgaagaggctataatgggccctaatattaacggtataaaatcgattacctccctcgatttaaaaaacgcgtttaatagcgtatccagggctgcaatagcctcgtcggtagctaaatacgcaccaactttctaccgttctacctgttgggcctataaccaaccttcgattttaataacggaaaacggttccgtcctggctagtgcacaaggtatacgccaaggcgatccgttaggcccgttgttattcagccttgcttttcgacctacgttggaaacgatccaaaaatcgcttccatatacgtatatagcggcttatttggacgacgtttatattttatccaaaacgcccgttaaagataaaatagccaaaataatcgaaaaaagcccgtttaccctaaattccgccaaaacgacagaaacggatatcgatacgttaaaaaccaatggtttaaaaacgctcggctcgtttattggaccaacggaattacggaaggaatttttgcaaaataaaattcaaaatttcgaatcgtccattaacgccctgaaaaaactccctaaacaatacggattgctaatcttgcgtaaaagtacacaattacttttacgccatttgctccgtactttaaattcccaggacctgtgggaattatgggaaaaaacagataaattaatagcggatttcgttataaatttaactgttacaaaacggaaaaaacggccaattacggatttcgttacgccgttaattacgttacctataaaggacggaggttttggattattacggcataacggaatagcccaagatatttattttgcggccaaggatttaacaaccgaaattcggcacaaaatccaacgtatatccaacgattttccacaaaatcaaagccctaccgccaccgagattttgcatttgttgcataacggggttttagcagattgcaaaaacgggttaacaaacgcccaattaaacgctttaaccgaaaacgctagttatttaggtcgaaaatggcttaacattttacctatccaaaaatcaaatcgattaacggattgggaaatggctgaagccgttcgattaagattattagccccggttaaaccgttaacccacccctgcaaccattgcggaaatcggaccaatataaaccacgaggacgtttgcaaaggtgccgtacgcaaatatacggcccgtcacgaccaaataaacagaagtttcgtcaattcgttaaaaagtcgaccagaaatcgacgtcgaaatcgaacccgatttaaataacgaaaataacgtaaataacgccaatacaaccaccgaaaatcccacccctagccccaacggccaaaacgataccggatgcctttttacaacccctattcgctccgggacccgtaacggccaaaacggccttagggcggattttgccgttattaacggcgtatccaaatattattacgacgtgcaaatcgttgcaattaataaggattccggtaatacaaatccgttaaatacgttagcagacgcagcaaataacaaacgacgtaaataccaatttttggatccatttttccatccaattataataagcgccggaggccttatggaaaaggatacagcacaggcgtacaaacaaatccaaaaattaataggccccgttgcggcccattggttggatacgtcgatttcgttaattttgttacggtccagaacgacggcagcaatttctattgctaaaaaccgccctcgtgcgtaataggtaacgtccctatttttgtctttggttttgtttttatctttgtttttgtttttgttttcgtttttgtttttgttttcgtttttgtttttttttttgtttttgtttttgtttttgcctttgtttttgtttttatctttatttttgtttttgtttttactttgttttatttgttttatatttaccttttgattttttctatttttcccacccttattattataaccccaacctactaatattttttcttttttcttttttctttttacggttttattttcccgtttgttttttctattttatttgtacgacaaaacccttagcaaataagcttagaatataataaagcgcgaattaaaa

SEQ ID NO: 1039 - DNA, 3666 bp, Branchiostoma floridae
ttttcagtctggctcagccagtgaccgccgggaaagtccggctgactaccacgaatagggtggtgacagctggatagacagacgacagctcggaaagacggcattggggcagtatgggttggcacccctaactgcatctcccctaggagagcatcccgcaacacgctacaaagaaccacaaagagcaatacccccagggatgcccgagagggggggaggatgagcatcccattcggacggtccaatcggtattgaccccagcaaacggagaatcgacaatgaatgcagtctgtgtgtgtggcaaggtatgtaagaaccagagaggtttgagaatccaccaaacaaagatggcctgcttaaggagggtgcaggcggagcaccgctcaggggctgtggcaaccactgtagaaccagtgttgtcagcatcagcccctggtcagacggaggaggatcagggcccggaagctccccacagtgcccggaacctccgcgcaacgcctgcccctccacaaggcaggaagtcagatcatcaccgagtgaagtggccagccgcaaactccaaggagtggtcgcagtttgacgaggacgttgacatgatcttggagtcggtgtcaagaggtagtacagaccaaaagcttcagtccatgtgcacagtgattatgtccatgggggcagaacgatttggcacgattgggcagaggaaaccgacagacacaatgaagccaaatcgccgggaagtaaagatccgtcaactgaggcaggagctaaagtcgttgaggcggagctttaaggcgagtacgtcgggagaggagagagctgctcttgcagagctcacacaccaccttagggagaagcttaggaccctcagaagggcagagtggcacaagaagaagggtaaagaaagagcccggaagcgcagtgctttcatcaccaaccctttcggcttcaccaagcgactcctagggcagaagaggagtgggaacctgacctgcccagtcgaggagatcaacctccacctcagcaataccttcagtgatgcctcgagagatgtggatcttggtccttgccctttgctggtgacttcacctgagccggaagtgcactttgacatctctgaaccaactctgaaggaggtcagagagacagtcaaggcggcgaggtccagttcggcgccaggtcccagtggcgtggtatacaaggtctacaaacattgcccacggcttgtggtgcgcctctggaggatcctaaaggtggtctggcgcagaggtaaagtggcggctgattggaggcaagccgagggggtttggatcccaaaggaagaggagtcaagtaaggtagaccagttccgcttaatttctctgctcagtgttgagggaaagatcttcttcaagattgtggcccagcgtctaataaagtaccttctggacaaccagtatattgacacatctgtgcagaaggggggagttcctggtgtcccaggatgtcttgaacacacgggcgtagtgacccagctcatccgggaggctaaggagaacagaggggacttggcagtcttgtggctggatctcgcgaatgcgtatggttcgatcccccacaagcttgtggaaacagcactgaccagacaccatgttccagagtcaattcagaacctcatcttagattactacagcaacttctggctaagagctggctccagtacagcaacttcagcatggcaacggttagagaagggcatcattactggatgtacgatttcagtgcccctctttgcactagcgatgaacatgattgttaaaggagcggaagcaggatgtaggggtcccgtgtctaggtctggaaccaggcagccgccgattcgagccttcatggacgatctgacggtgatgactgcaacagtcccggtgtgtagatggctcctacagggattagagcgtctcattacatgggcacggatgagtttcaagccggccaagtcaagatctcttgtcctgaagaaggggaaggtggctgaaaggttccgtttcaccctgggaggcactcagattcccacagtgtcagagaaaccagtcaagagtctgggcaaggtgttcaacagctctctgaaggacaccgcttcagttcagcagactaggagtgacctgacaacgtggctcgagggaattgacaagacagggctacctggtagcttcaaggcctggatgttccagcatggagtcttgccaagggtactctggcctcttcttgtgtacgaggtgccgatgaccatggtggagcaactggagagaaccatcagcaggttccttcgcaaatggttggggctcccgaggtccttaagcaacattgccctgtacggtagatccaccaagctgcagcttcccttgagtggcctgactgaagagttcaaggttacccgtgcaagagaagtgttgatgtaccgggactcctcagactccaaggtctcttcagccggcatccatgtcaggactggaagaaaatggaaggcacaggaagcagtggatcaggcagaggcaaggttgagacacagtgtcctcgtggggtccgtggcagtaggacgggcaggactgggcagctgcccaaagcctcggtacgacaaagtcagcgggaaggagaagcgtctactgatccaggatgagataagggctggggaagaggaggatcggcgatgcaggatggtaggcatgcgcaagcaaggtgcgtggactaggtgggaacatgctgactcccgcaaggtcacatggccagagttgtgcagagctgagccttctcggatcaaatttctcatctcttcagtgtacgacgtgcttccaagtccagctaacttgcatgtctggggcttggcagagaccccctcatgccaactctgtcagaggagaggtacccttgaacacattctcagttgttgtccgaaagcactaggggaagggaggtaccgctggcggcatgaccaggttcttagggtgttggcagacacagttagcaacgccatccagagtagcaggagtcagcaaccccccaagaagtcaattgtctttgtcagggccggagagaaaacccgacaacaacccacttccgcaggtgggcttctctccactgctagagattggcagcttctagtcgaccttgggagacagctcaagtttccagaacacattgtagccacgtcacttcgccctgacatggtactcgtgtcagaatccaccagacaagtggttctgctggagctaactgttccctgggaggagcggataagcgaagccaacgagcggaagagggcgaagtatgccgaactggtagtacaaagccagagtaatgggtggagagcccggtgtgtaccagtggaggttggttgccggggtttcgcagggcagtctttggcttatgtgttaaaactccttggagtaagaggtttccgtcttcggaaatccatcagggatattctagaggctgcggagaaagcctcacgttggttgtggttccgtaggggggaaccgtggaagccacacggacacaggtcggggaatgatcaacctcggctgggtcgcccgggcgagggtgtatggtgattaaagacccgaaacacccaatgaccccgggttcatcactgatgatgtgtccctgttcgcactaccagagtgtattctagag

SEQ ID NO: 1040 - DNA, 3639 bp, Danio rerio
ttcaagcctggcgcagccagtgactcctaggaatagactaggtggcaaccaagaatagtttggtcgactactggagagacagttgacggcacggaaagacggcacttgggacagtatgggttagcaccccagcctgtgtctttcgtgagagagaacccaaacaagctacggaaagccccacagagatatacccccaggagatcccgagagggggggaggatgagatctccaatcggacggatcaaaggttaatgacccatgcaaacgaacagacgacgaacaaaatatatgtgacatgcatttgcggaaagctgtgtaagaaccattggggcctaaaaatccatcaggccagaatgaaatgtttggagcaggagagtaaggtgcaacgcacaggtcctgaacctggtgagacgcaggaggagcccggcccggaggcaacccacagagccaagtccctccatgtaccagagcctcaaactccaagcgaagtagttcaacagcggattaaatggcccccagccagcaaaggaagtgagtggctgcagttcgatgaagatgtgtccaacatcattcaagccatagccaaaggagatgcagatagccgactcaaaacgatgactaccatcatcttcagctatgctctagaaagattcggttgcatagagaaaggaaagaccaagcccaccaccccctacactatgaaccgtagggctacccagatacatcacctgcgtcaggagcttcgctccctcaagaaactgtataagaaagctacggatgaggagaagcaaccattagcggagttgaaaaacattttgcggaagaagctgatgatcctacgcagggcagagtggcatcggagacgagggcgagagagagccaggaagcgagctgccttcatcaccaatccctttggcttcacaaaacagctgctcggggacaagcggagcggtcgacttgaatgctcaatagaggaagtgaatcgcttcattgaggaaacagtgagtgatccactgagagagcaggagctggagcccaacaaagctcttatcagccccacccctccagcaagagagttcagtttgagggggccaagtctgaaggaggtcaaggaaatcattaaggcatctcgctcagcatctactccaggccctagtggcataccttaccttgtctataagcgctgcccagggcttctcctgcatctgtggaagatcttgaaggtgatttggcaacgaggaagagttgctgagcagtggaggtgtgccgagggagtgtggattcctaaagaggaaaactcgaaaaacatcaaccagtttcgaatcatctctctattgagtgttgaagggaaggtgtttttcagcatcgtctcacgaagactgacagagttcctcctcgagaacaattatattgacccttcagtgcagaagggagggattcctggagctcccggctgcttggaacacactggagtagttacacaactcatcagagaggcccatgagaacagaggggacttggttgtcttgtggttggacttggcaaatgcctatgggtccataccccacaagctggttgagctcgctctacaccgccaccacgttcctagtaagattaaggacctaattctggattactacaataatttcaagatgcgggtcacatctgggtcagaaacatcaagctggcatcgcatcgggaaaggaataataacaggctgcaccatctcagttattcttttcgctctcgccatgaacatggtggtcaagtcagccgaagtggaatgcagagggcccttaactaagtcaggtgtgcgacagccccctattagagcatatatggatgaccttaccatcacaacaacaacggtcccagggagcaggtggatcttacaaggacttgagagactcatcgcctgggctagaatgagttttaagccctccaagtctaggtccatggtgctgaagaaggggaaagtggttgacaagttccatttttccatctcaggaagtgtcatcccaaccatcacggagcaacctgtcaagagtttggggaagctctttgactccagcctaaaagactctgcagccatccagaagtccaaaaaagaacttggagcttggctggcgaaggttgacaaatccggcctgcctggtagattcaaagcctggatctatcagcattcaattctgccccgagttttgtggcctctgctgatctatgcagtcccaatgtcaacagttgagtccctagaaaggaagatcagtggctttcttcgaaaatggttgggcctcccacgcagtcttaccagtgctgcactatacgggacaagtaacaccttgcagctaccattcagtggcctcacagaggaattcatggttgtacgcaccagagaagccctacagtacagggactctagagatggcaaggtgtcatcagcctgcatcgaggtgaggacaggcaggaaatggaatgcagggaaagcagtggaggtggcagagtcacgcctgcaacaaaaggctctggtgggcactgtagcgacaggcagagcgggcttgggctattttccaaagaccttagtaagccaggtcaaaggcaaggaaagacaccacctactccagggagaggttcgagcaagtgtggaggaagagagagtcagtagggtggtaggactccggcagcagggagcatggactaggtggaatacactgcaacgtaggatcacctgggcgaacatcttgcaggcggatttccaacgtgtccgtttcctagtacaagctgtctacgatgtactgccaagcccatcaaacctccacgtttggggaaagaatgagacaccttcctgccttctttgctctggaagaggctctctagaacatctcctcagcagttgccccaaggctctggctgatggtcgctatcgttggcgccatgaccaggtgcttaaggcaattgctgcgagcttagcttcagccattaacacgagcaagaaccatcgtgctccaaggaaggcagtccacttcatcaaagctggagaaaaaccccgggccctcccacaattaacaacaggcctccttcacaaagcctcggactggcagctggaggtcgacctgggaaaacagctgaggtttcctcatcacatcgctgcaacacgtctccgtccagacattatagctatctcagaagcttcaagacagctaattattctggagcttacagtgccgtgggaagagcgtattgaagaagcaaatgagaggaagcgcgctaagtaccaggaattagtggaggagtgcagggagagaggctggagaacttactatgagcccatagaaattggatgcagaggctttgcagggcgttcactttgcaaagtcctcagtcgtttgggcattacaggcgtggcgaagaaaagggccattcgatccgcaagcgaagccgcagagaaggccacaaggtggctgtggattaagagggcagatccgtggactgctgttgggacacaagtcgggacttgatcaaccccggctgggtcacctgggtgagagtgtatgatgttgagagacccgaaacactcaatgatcccaggatacatcactgatgatgtgtcccaaatgcatccatgagatgtttcttgcataa

SEQ ID NO: 1041 - DNA, 3487 bp, Branchiostoma floridae
ctgaccagcagacgggaagcccgcgaccaactagtctccgcaaatattgcacacagggcgaccctatggagctgattcagtcaaatttcctctgagatataccgataactatctacagaaactgcacagttagtttggaaagagcttttctactgaaagacagcaaaatccgccactttagacgagcgtcaagactgccctccccataaccaatatggcgctacctgctgtacgttctggaccagccagcacctggacactgttaatcacgctggtcatcgtcgctgctaaaggtacagatggttttatgtcttttaaactgccactgctgtctactgatacctggtctgggtataacaatgatgtgaaaaccctgctaggcccgctccaccacgaactggccacaaatgaaatgtcccccaaactagctggggagggattcagtgacatcatgtgcgactttatggccagtaaaccagagttcagccacactaccgaagaaagtcactcagaaggctatataagccacgaaccacagtctctcgcacaagtaaaacgcctgaaaaacaagctacgtaagaaggcattcagagctgacgcaacacctgaggatcgaaaggctttcagagatgcaattaaaacatactccttcatgaagcgacaacagaaacgaaaggaaactacaaaatcggcagcacaccaagagaaagaatatcataagaacttttggaagtttgccggaaaatgtgcaaaaggacagctcgatatccccccagtaaaaccggcattctctgtttattatgcaaatgagtactacaaaaacaaatactcacacccaacccgtgttgacttcaacaaactgctctggtttcctcatttgccggtggaggaacaactacctgcgaactcttttgacatgtcacctgtcaggccgaaagacattaaggcagtcttatccaaacgatgcgctacatctgcacctggcccggacgggatcatgtatggccacctcaagcacctgccagcttgtcacctgttccttagtacactgttctccaaactgcttgagtccggagacccaccgacatcatggtcatctggcaacgtgtcacttatacacaaggatggtagtccagaagctgccgaaaactttcgaatgatctgccttacttcctgcgtctccaagattttccaccaaatactctcggaacgatgggcaaagtacatgacttgcaatgatctgatagacccagaaacacaaaaggcattcctgaccggaatcaacggctgtgtggagcatgtccaagttatgcgggagatcttagcacatgccaagaaaaaccgccgaacagtccacattacatggtttgacctcgcggatgcctttggttctgtagaacacgaactgatctactaccagatggagagaaacggcttcccgccaattatcaccacgtacattaaaaacctgtattctcgcctgaaagggaaagtgaagggtccaggctgggaaagtgatccgttcccgttcggaagaggagtgttccaaggagacaacttgtcacccatcatcttcctaacggtgttccagcctattctacagcatctcaagggagtagagcagcaacatggctacaacctcaatgacaagcattatgttacactgcctttcgcagacgacttttgtctcataaccacaaacaaacgacagcatcagaaactaattactcaaatttcttccaacacaaagtcaatgaacctaaagctaaaaccacgcaagtgtaagtctatgtctatagtgagcggaaagccatcggacatcagcttcacaatagatggggaccctgtcaaaacgaccaaagatgcaccggagaaattcctaggtggctacatcaccttcctgagtaaaacaaaagagacctatgacatcctagcaaagacaatagaaacgactgttgaaaacataaacaaatcagcgataaggaacgaatacaaactcagggtttacatggagtacgccttcccatcttggaggtacatgctgatggtacacgacctgacagacacccagctacaaaaactcgattccatccacacaaaggcgatcaaaacatggctcagaatgcaacctagtgcaacaaatgcaattctgtacaacacaaggggtctcaacttcaaaagcatctcagacttgtacctagaagcccacgctctggcctacagtaggtcagtcctcaaagcagatgagaaggtaaaacacgctttacaagccaaactggaccgcgaatcgcaatggactaggaaaatgcagaaatggggtattggaaagtgtcacaccatccaccagcaagccatccatgtagcaaaggactcagaatggacatcagtacgcaaacatgtcaaacaacaagtcacagatatgcgtcatgacgtctggactaaacatcaggaaaaccttctacagcaagggcagatgctacaactgcttgaggaagaaaaatgcgacctgacatggcggtccgctatgtacaacctgccgaggggcatcctcagtttcgctgtgcgtgcctccatcgacgccctccccacactctgtaacctgaccacctggggaaaacgtaacactgacaaatgtaaactgtgtggcaaccgggaaacactccaccacgttctgaaccactgcggtgtcgctctccaacaaggacggtacacattccgacacaactcggtattgaagcacataacggacaccatcatagagtccattgacacctctcggatcaacgccaccatctatgcggacatacaaggttacacaactaacggaggtaccatcccggtccatacaatacccactacccagaaaccagacctgatcatatatttaccagaacagaagaccctccacatccatgaactgactgtaccctttgaaaagaacatcaaaacaagtcatgaccgaaaggtcaacaaatacagcaccctagcggcagatttagaaactgctggcatttccgctacactaacctgctttgaagtcggatcaaggggactcgtcacgccagagaacaagaccaggcttagaacactgttcaaaatagttaaagccaaaccaccgaagactctgtttactgatataagccgcattgcgatgttatcgtcatatgctatttggaactcacgccacgaaccgtattgggagtcagaaacgctattgtagaaacccacaaggctgagaaatgtagagcatctgtatggacaatattgatgattgaaatgttgtgattttagatcaaatttagaaatatgaaaaccgaactaaactaaatataatgttttttttaaagtaatgataagcaatacccacattgtgcaatactatctatgttatgtcctttgtcccccctgcatgtttggtcaataatgaccatcgtgtcctgggctccgtgtacctttctttactatgaataaagaatgattttactac

SEQ ID NO: 1042 - DNA, 3388 bp, Danio rerio
aaagcagtagagatgacgacacatcgcgcagaagttacaacttctggtaagacgcaggaggagccaggcccggaggcaacccacagtgcccagagcctcctagtgtcgccaacacctgctgccggccgctcgcctgctactcaaagctgccctcaagtgacagcagctcataacagtccacaaagcccccaaagtcagcaagtggcagttacaagatctgactgtgttcccttggcacagccaagaatccagtggccccaatcctcaaagaaagctgagtggctccagttcgacaaggacgtgaatcagatcctggaagtgacaggcaaggggggtgtggaccagcgactgtcaacaatgaccacgctcatagtgaacattgcagctgagcgattcggaactgtgacacccaaacccactccatcgacatatactccaagccacagagtaaaggaaatcaaacgtctcaggaaagaacttaagctactaaagaggcagtacaaggcagcaggggaagtagaaagagcgggcctagaagatctgagaggaatcctgaggaaacagctcgtgaacctatgtagggcagagtatcacaggaagaggcggagagagagagcaaggaaaagggcagcatttttggccaaccctttcaagttgaccaagcagctccttggccaaaagaggactggcaaactcacctgctccaaggaggctatcaacaatcacctcaaggccacttattctgacccgaatagagaacaacccctggggccttgcggtgcactgctgacaccacctgagcccacatcagagttcaacatgaaggaaccctgccggagtgaagtagaggaagtggtgaggagagcaaggtcaagctcagcaccaggcccaagcggagtgccttacaaggtatataagaactgcccaaagcttctacacaggctctggaaggccctgaaagtcatatggagaagagggaagattgcccagccatggaggtatgcggagggagtgtacatcccaaaagaggagaagtcggagaacatcgaccagtttcgagtcatctccttgctcagtgtggagagcaaaatattcttcagcattgtggccaaaagactctccaacttcctattgagcaataaatacatcgacacgtctatgcagaagggaggcataccaggagtcccaggctgcctggaacacacaggcgtggtaactcagctcattagggaggcaagagaaggcaggggggacctggctgtgttgtggttggatctcaccaatgcctatggctcaataccccacaagctggtggaggtcgcactggagaaacatcatgtaccccagaaggtgaaagacctcatcatcgactattacagcaagttcagcttgagagtctcctctggccagttaacatcagattggcaccagcttgaggtaggaataatcactggttgcaccatctcagtgaccctctttgcactggcaatgaacatgatggtcaaagcagctgagacagagtgcagaggccccctcagcaagtccggagtaaggcaacctcccatcagagccttcatggacgacctcacagtgacaacaacgtcggtaccaggagcaagatggatcctccaagggttggagaggctcgtggcatgggcacgcatgagcttcaaacctgcaaaatccagatccttggtgcttaggaaaggcaaagtcagagatgagttccgcttcaggctgggacaacaccaaatcccatcagtcactgagagaccagtaaagagtctcgggaaggcctttaactgtagcctcaatgacagagactccatcagggaaaccagcactgccatggaggcttggttgaaagcagtggataaatcagggctccctggaagatttaaggcttgggtttaccaacatggaatccttccaagactcctctggcccttgctaatctatgaggtccccatgactgtggttgaaggttttgaacaaaaggtgagcagctatctacgcagatggctgggattgccacgcagcctaagtaacatcgctctgtatgggaacaccaacaagctcaaacttccttttggctcagtcagggaggagttcattgtggcacggacacgagaacatctgcagtactctggatccagagatgcgaaagtgtccggggcagggattgtcatcaggacagggagaaagtggagggcagcagaggcagtcgaacaagcggaaacccggctgaagcacaaggccatcctgggggcagtagcacaaggcagagctggacttgggagcctagcagcaacccgatacgactcggccagtgggagggagaggcagaggctggtgcaggaggaggtgcgtgcttcagttgaggaggagagaaccagcagagcagtggccatgcggcaacaaggtgcctggatgaagtgggagcaggcgatggagcggaatgtcacctggaaggacatctggacatggaaccccctgagaatcaggttcttgatccaaggggtctacgacgttcttcccagcccatcgaacctgtacatatggggcagagtagagacacctgcatgcccgctgtgttccaagccagggacactagaacatattttgagcagctgttccaaggcactaggtgaaggtcggtatcgatggagacacgatcaggtccttaaatccattgctgaggcaatcagcaaggggatcaaggacagtcgataccgccaagccacggccaaggtcattcagttcatcaaggaaggacaaaggccagagagaacagcaaagaactgctctgctgggttgctctccacggcccgagactgggtgatgacagttgatcttgagaggcagctaaagattccaccacacatcacccagtctacgttgagacctgacataatcttggtctctgaggccacaaagcaattaatcctgctggagctgacggtgccctgggaggagaggatggaggaggctcaggagagaaagaggggaaaatatcaggagctagtggagcaatgtagggcgaatggatggaggaccaggtgcatgccagtggaagtgggcagtaggggatttgccagctacaccctgagcaaggcctatggtacactgggaataacaggcacaaaccgaagaagagccctaagcaacaacgtggaagcagcggaaaaagcatccagatggctctggttgaagaggggggaacagtgggggcagtagcatgccacttggacacaggccggggtctgatcagcctcggtcgggtcgcctggaggagggtgtctgttgcaagacccgaaacaccctgtgagcccaggaaacaacactgatgatgtgtccaaggttgtgcatcaggagatgtttctgtaac

SEQ ID NO: 1043 - DNA, 3595 bp, Takifugu rubripes
agactaggtgacaaccaagaacagttwggtcgactactggaaagacagttggcagctcggaaagacggcacccgggacagtatgggttagcaccccagcctgtatctttcgcgagaaggaacccaaacaagctacggaaagccctacagagaaacacccccaggagatcccgagagggggggaggatgagatctccaatcggacggacctaacgttaatgacccctgcaatggaaatgactacgacagtaacatgtatctgcagcaagctgtgcaagaaccagcgtggcttaaagatccatcaggccagaatgaaatgtctggagcgggaggttgaggtgcaacgcacaggtcctggacctggtgagacgcaggaggagcccggacaggaggcaacccacagatcccagtccctccacgtaccggagcctcccaaccctaacagagtagttcaacagcagcggattaagtggcccccagcaaatagacggagtgagtggctgcagtttgatgaggatgtgtccaacatcatccaagccacagccaaaggagatgtcgacagcagactccaggcgataagtaccatcatcgtcagctatggctcagaaagatttggacggatcgagaagggcaacactgagaccacctcttacaccatgaaccgcaggtcctttaagatacaccaactgcgcaaggagctgcgaaccctcaagaaacagttcaagagagctkctgatggggacaagcaagctttaaaagagctgtataacatcctgcggaagaagttgaaaactctccgcagagcagagtggcacaggaggcgcgggagagagagagcaaggaagcgagcagccttcattgccaatcccttccggttttctaaacagctgctcggggacaagcggagtggccgacttgagtgctcaagggaggaagtgaatcgcttcctccaaaacaccatgagcgacccactgaggggtcaagacctaggacccaacagagcgctcatcagccctgccccaccatcggcagagttcaagctggcagagcctagtttgaaggaggttgaagaagtcatcaaggcagcccgttctgcatcttccccgggccccagtggtgtaccttacctcgtctacaagcgctgtccagaaattctccggcatctgtggaaggccttgaaagtgatctggcgaagggggagagtagccgaccagtggaggtgtgctgagggactttggatacccaaggaggaggactcgaaaaacatcaaccagtttcggactatctcactactgagtgtggaagggaaggtgttttttagcatcgtctcccgaagactgaccgagtttctcctcaagaacaactacatcgacacttcagtgcagaagggtgggatccctggagtccccggctgtctagagcacaatggtgtagtcacacagctcatcagagaggcccatgagagcaaaggagaactagcggttttgtggttggacctgactaacgcctacgggtccatcccacacaagctagttgagcttgcgctacacctacaccatgttcccagtaagatcaaggacctgattctggattactataataacttcaggctcagggtcacttcagggtcagtaacctcagactggcatcgccttgagaaaggaataataacaggctgtaccatctccgtcgttctcttcgtactggcgatgaatatggtggtaaaggcggctgaggtggagtgcagagggcctctatccagatcaggtgttcgacagccccccataagagcctacatggacgaccttaccgtcacaacaacatcagtcccagggtgtaggtggatcttgcagggtttggagagactcatcctatgggctaggatgagttttaagcccaccaagtcaaggtccatggtactgaagaaggggaaagtggtggacaaattccgattctcaatctcaggaaccgtaattccatcgatcacggagcaaccagtcaagagcctgggaaagctctttgactccagcctgaaggacactgctgctatccagaagtctacggaagagcttggagggtggctcactaaggtggacaagtctggcctgcctggtagatttaaagcctggatctaccagtactccatccttcccagagtcctgtggcctctcctcgtgtatgcagtcccagtaacaacagtggaatcctttgaaaggaagatcagcagctttctgcgcagatggctgggtcttcctcgcagcctcaacagcgctgcactgtacgggacaagtaacaccctgcagctacccttcagtgggctcactgaagaatttaaggtggcacgcacaagagaagccctacagtacagagactccagggactgcaaggtgtcatcagccgggattgaggtgaagacaggaaggaagtggaaggcagaaaaggcagtggakgtggctgagtcacgcctaaggcaaaaggcactagttggggccgtggcaacaggaagaacaggcttgggctacttcccaaagacccaagtcagccatgcccggggcaaagagagaaaccacctacttcaggaggaggtccgagcaggcgtggaggaagagcgagtgggtagggcagtgggactccggcagcagggggcatggacaaggtgggagagcgcgttacagcgcaaagttacctggtcaaacatcatgcaggcagacttccaccgcgtccggttccttgtggcggcagtctacgatgccctccccagcccagcaaacctccatgcgtggggaaagagtgagacacccacctgttccctttgctccggaagaggctccctggaacatctccttagcagctgcccaaagtccctggctgatggtcgctatcgctggcgccacgaccaggtactcaaagcagtggctgagagcatagccttggccattagcaccascaaacaccatcatgctccgaagaaggcaatctccttcataaaagctggagagagacctcgtgcaggcccacagataacaacgggactcctccacacagctmctgattggcaactgcacgttgacctgggaaaacaactgatattcccccagcacatcgcaacaacgtctctacggccagacatgatcatcatctcagaggcttcgaaacacctgatcatgctggagcttacagtgccctgggaagagcggattgaggaagccaacgaaaggaaacgtgccaagtatcaggagctggtggaggagtgcaggggcaggggctggaggaccttctacgagcccatagaagttggctgtagaggctttgcaggacgctccctctgcaaagcctttggccgactgggagtcacagggacagccaaaaagagggccattaaakccgcgagtgaagctgcagagagagccacgaggtggstgtggctkaaaagggcagatccgtgggttgctactgggacacaagccgggtcttgatcaccccggctgggtcgcctgggcgagggtgtatgatgtcgtgagacccgaaacaccctatgaacccaggatacatcctgacgatgtgtcccagtgcatccaggagatgtakctttaagt

SEQ ID NO: 1044 - DNA, 3711 bp, Tetraodon nigroviridis
agattggtctggctaagccagtgacgtccaggaacagactggctgacgaccacgaatagagtggtgacagcttggatagacagctgacagcagggaaagacggcaaccggggcaggaagggctagcaacccagcctgcatcttccgtgaggaagaacccaaaacttgctacgaagagcccgaagcaaagatacccccaggggagcccgagagggggggagaatgagctccccaaacggacggataacatggcaacgacccaggctagcgttaaaccgacagcggttgccacatgtgtatgtggcaaaatctgcaaaaacccacgaggtctgaagatccaccagaccaagatggggtgcttggcaagtgtgcaaccagagcagcgcgcaaggttcagcctcagcgagtcgcgggaggtgccagccagggccgagccctatggccctcagcaaccgcattctcctgaggcccttggtgagacgcaggaggagcggggccaggagtcaccccacagtgcccagaacctccgtgctcaggtagcacaagcgccagacaacccacaacaccaccggcgggttaagtggcccccagccagcaaagtgagcgagtggcagcagcttgatgaggatttggaaggtattctggagtccaccgcaaaaggtggagtagacagaaaactccaaacaatgaccacgctggtcatcagctttgccaccgagagatatggtacaatggagaaacgcgctgctccagagaagtacaccaaaaaccgcagggcagaaaagatctcccaactgcggcaggaacttcgggtcctgaaaaagcagttcaagggcgccagcgaggatcagaagccaggattggcagagcttcgttgcacccttaggaaaaaactgcttacccttcgccgagcagagtggcaccggagacgggccaaggaaagagccaagaaacgcgctgcatttttagccaacccttttgggttcactaaacaacttttaggccagaagcgtagcgcccacttggaatgtgcaaaagaggaggttgattcctacctccacgacacattcagtgacgcagaacgggagaacagcctaggcgaatgtagagtgctgatcagtccacctgagccagcctgcagtttcaacaccaaggctccaacttggaaagaaatccaaactgtggtcagggctgcaagaaacaactcagctcctggacccaatggagtcccatatctggtgtacaaaagatgccccaaactcctagcccggctctggaagatcctaagggtgatctggagaagggggaaggtcgcccatcaatggagatgggcggaaggggtgtgggttccgaaggaggagaagtcaaccttgatagagcagtttaggaccatctcactgctcaatgtcgaggggaagatattctttagtatcctctcccatcgtctatcagacttcctccttaagaaccagtacatcgactcctcggtgcaaaagggggggatccctggggtaccagggtgtttagaacactgtggcgtggtgacacaactaattagggaggcgcgcgaagggagaggtagcctggccgtactttggctggacttagctaacgcttatggctccataccccacaagctggtggaaatggcattagcgaggcaccatgtcccaggcccgatcaagactctgatcatggactactatgatagcttccacctgagagtcacgtcaggcagtgtcacatctgaatggcaccgactagagaaagggatcatcactggatgcaccatctcagtgataatattcgccctggccatgaatatgctggccaagtcggctgagccagagtgcagaggacccataaccaagtcaggcattcgccagccccccatcagagcattcatggatgatctgacagtaacaacaacgtcagttccagggtgccgttggatcctccagggcctggagaggcttatgacttgggcccgtatgcgctttaaacctggaaaatctaggtccttagtcctgaaggcagggaaggtgaccgaccgcttccgcttctacctgggaggcacccagattccatcagtctctgagaaaccggtgaaaagcctaggtaaaatgttcgacggctccttaaaggatgccgcttccatcagggaaaccaatgatcagctggggcactggctgacgttggtcgataagtcaggtcttccggggaaattcaaggcatgggtataccagcatggtatcctacctaggatactgtggccactgctggtgtatgaatttccaatttccaccgtggaagggcttgagaggagggtcagcagctgcctcaggcgttggctgggactacctaggagtctgagcagcaatgccctctacggtaacaacaacaagctgacactccccttcagcagcctggcagaggaattcatggttaccagagctagggaagttctccagtacagggagtccaaggatcccaaggtagctcttgccggcattgaggtgcggactggcagaaggtggagggctcaggaggcagtggaccaggcagaatctcggctgcaccacaaagagcttgtgggagccgtggcgactggccgtgcaggcctgggaacaacaccgaccacccacctcagcaggctcaagggcaaggaaaggcgggatcaggtccaactagaagtgagggccagtattgaggaacagcgagctagtcagtgggtggggctgaggcagcaaggcgcttggactaggtgggaagaggccatggccagaaagatctcatggcctgagctgtggagggctgagcccttgcgcatccgcttccttattcagtcagtttatgacgtcttgcccagcccatcaaacctcttcctgtggggcaaggtggaatccccatcatgtcccttgtgccagggaaggggcaccttggagcacatcctcagcagctgtcccaaagcacttggagagggtcgctatcgctggcgtcacgaccaggtgctgaaggcaatcgctgagtctatcagctccgccatggagtacagcaagcgcctacccttaccgggacgcggagttaggtttgtcagggccggtgaacaacctcctccccaaccaagggcccaaccaggcctccttgcaacagctagggactggcaactaagggttgacctggggaaacaattaaagttcccggaaaacatcgtagaaaccaacctgaggccagacattgttctgcactcacagtcgtccaagcaagttattttgctggagctgactgtgccctgggaggagagaatggaggaagcgtatgaaaggaaggcagggaagtacgctgagctggtggaggattgccgcagagcagggtggcgcagtagatgcctgcctatagaggttgggggtaggggctttgcagggaagtcactctgcaaggcctttagcctcctgggcatcacaggcatgcgcaggaggaaagccatctgcgcggcctcagaggctgcagagagggcgtccagatggctgtggatccagcgggacaagccgtggacgagcgcttcttggacacaggccgggaactgatcactcccagtcgggtcgcctgggtgagggggtctgatgttgaaagacccgaaacccccgatgaccccaggtactatcactgacgatgtgtccaagacatgcatcaataggtgtatttagaaatc

SEQ ID NO: 1045 - DNA, 5304 bp, Schmidtea mediterranea
aaacgacatcatgaacgcttggccgcaacaatccagttatccctgcggtaacattgtggaactcataagacaagtactaaaagaagaattagaaaaattagaagaaaaaattgaaaataatttatttataaaatttaaaaatttaaataaatttaaaaatttaaatttaaatttaaatgaagataaaaatttatttaatccaataaataatcaagaaaatcaagaaaatgatggattcaagacaattaaatactccaaaaataagaaaatatcagaacccaaaaatgacaaacgacatcatgaaaagctacaactacgcggttttgagcgatgtcacgcctcaagaaaccactcaaacaacaacccacttaaatgtcgatatagacaatgaaaccacccaaccaaaacagccacttacgaagtctggcaaaccaaaatctaaaccaattgcggtatcatacaaatttaaagatgccaccttcatctgggacactaccccacaaacaaatccaccaagagattgcaccaaacttattgataaaacaagaccaagaaagaccatcttcaaaaaatcagcatttcaaagctacctcaaaaaagaactgtccaatgagacatttgtggaagtaaaaaccttcctcatggcaactcacaaatatcgttttaaagacgaaaactcaagactcttggcataccgaataattaatcgctatgtcatggagacagcaaatgaattcaaagaaaccgaatttgacatggctcgctttgccaaattcttcacaatcccagagaattggttaaaacatctaaaaccatactctacagctaccgaaacatcaccggctgatagaataaaagtacaaaaattagtggatctcacatgcagatacccattcaaaactcaagaagagcaaacaagtgtagcaaacttcctacacttcttcacccaaagatcaataattggaatctcaagagattataaattccaaaaatttataccatttatggcaagaaaaaacaccaggccggagacaacctccactatggttacgacttctccaacagaacaaaacagactaccaatggtaataatcacaccacttgaagaaccaaaaagtgaacatcgtagaccagagaaaagaggcgcaagcaatgacacaattgtgcttagcgacgaagagttcccactacttaaaaggagaactcttccaaccagaaaatccaaaaatcctactggtgcaggaaatgtaccwacagaaaccgaatgcactgatgaagttaaattcatcctcaacaatgaataccaaatagaatgtaaagagtgtggaaaagtgtgggaaaacgtacgaaatggattaaaccaccttcgtcaaaaacacgatttcccaaaccgaacagatgttatggtatcttgcgtaagatgtgaagtaccgatcaaaggagcagaatgtgtaaatcacattaaaaatcacaaaaaagatgacaaagaagaaagtgaagcsgggagtcttgtggctaacactcaagacatcccaaatgaaagtagctgactgtcacaagccgcaatcgaagtatatctgaggaatattctgaaaatgaaagaaaaccaggaaaggaatattcaatatcttgaacctagtactgcgaatttcctcataaataggaacctcagagcattttatcaaaacgtcaaaatcgaaaagcttatcggatgggaacaagtcatctggcttatacattggaacaaatgtcattggattgtatacctagctaattgcgactcaaaaacctctgttatcttggactctgacaaccaaatgacattacagcaaagatgtaacataaaagccaaatttgacaaattcctagaaggtacctttgaagaaaaaacagtgcttggaaccctagaaagaaaagttcctcagcaaccaaacaacttcgattgcggtatatatgtgatacaatacatcagcgactttcttaaagacccacaaagaatagattatcatacacccgactccaaaagaattagaaaagaaataggagaattaatattagaagaaatgaaaaaccctgcctcaaaaatcaaaaatccaaacaaagaaatacaatctttactccaaaaattcagactactgcaaatcaatgtgaatgatgtattccattggtttgcggctgaataccaaaaatctctaccgaagatacgtaccaaaagagatggaaaactgaataaactaagctgctcctatcaaatccaaagattatttggtctagctcctaaaagagcagtcaaagaaatatatttccaagaaacctctacagcagacttggaaacaagagttctaaatgaacatttcaaaaaggatgaatcaacgatgaaagaatgtaaaataaaaaatggaaaccattaccaagactggataacaaaggcccaaattgataataaagaaatattggaagccctaaaaaacagtacagattctgcccccggagaagataacattcctctgaggcaatggataatctggaacaacgacggtgtcctctttgatatgtttaactacatcaaaaggacacacgatatcccagatatgtggaaaaactacaccacaacactacttataaaacccggaaaaagccaagaaagcaacatccccgctaattggaggccaatatcgatattgccaacaagctatcgtatatttatgaaagtcctaaataaaagagtactagaatgggctaatagaggagaactgatatcaaaatggcagaaagccgtagacaaagctaatggatgtgatgagcacagctatgtcatacaagcgcttatcgaaaaagcaaacagaagctactacaaaaacgagcaatgtcacctcgccttcttggatttggcagatgcttttggaagcatcccattccaagtaatatggcataccctaaaaaatatgggtatggatgaggaaaccatcaacttgctcaaagaaatctacaaagattgctccacaaaatataaatgtggaaagaatgagtcagaaaagatcaaaattacgaaaggagtccgacagggatgcccattgtcgatgaccctcttcagcctctgtatacaatatcttatacaaggcatagcagaaaagaaaaaaggagcaacaattgcaggtcaagaagtttgcatattggcttatgcggacgacctagtaattgttgcaaacacagcaaaagacatgcaaatgctgttaacaacaatcgaaaatctggcaaaacaagccgatctcatattcaaaccggcaaaatgtggatattacagagacccaagagataaaaagtccatgatgaagatatatggcaaagaaatcagcatagtagacgaaaagaatgtttacacctacctaggtgtaagaatcggtgacacaaagaaaaaagacctaaatgtcagattcgaagaggtcaaaaagaaaacgacagcaatcttcaaatcgaaattgcgaagtgaccaaaaactagaggcatacaacatcttttgccaatcaaaatttgtgtacatcctacaaggcgaagatatcgcaaaaaccaaaattgaaacttacgacgaagaaatcaagaaaatgataaaagaagatatattaaaattacaagacaaaagtccgttcacagacttcgttatctactccccaagagaaaaaggggggttaggaataacaaagataatagatgaacaaacaattcaaactattaatagaacggcaaaactcctaaatagtagccatagagcaatccgggctattatttatgaagagctaatacaagtagctaacctaagaggagaaaaagaaatcaacaccattgaagaagcactaaaatggttggaaggtaccaacaaatacaaaaagaactccaacgccaagaccacctggataacaagggttcgggaggcctttcaaactctagaaaagaaacacaaaatcaaggttagatttgtgcccaaagaaaactgcattggatataaaatcaaatgcgacacccaagaaaagatagtggagcttgataactcaaaagagttatcaaaaagcttacactggatgataaaagaggcatattataaagaatggaaagccctaaaatgccaaggatatattataagcctaaaaacctccgaatttatggagtggaaaatgcccagaggccttccggaccctgattggagattcctaacaaaagtaaaggcaaatatgttggacgtaaacatgaaacaagccaaccagggaggaaggttgggaagcacaaaatgccgaaaatgtgaagataaagaatcggcaagccatgttataaaccactgtgcctcaggtaactggagtagagtggaaaagcacaaccaggtgcaaaatgagctagcaaaagaactgacaaagcggaatatcagcttcgaaaaggacagcatcccaaaagaaacaaaagagagcctaagaccagatttggttataagactcaaagacaagataatgatagtggacatcaaatgcccatttgatgaggaatctgctatcgagagtgccagaaacaagaacatagacaaatatcgagaactggccaaagagatccaagcaaaaactgggttacaaacaacagtctcaactttcgttgtctgttctttgggaacctgggataagaggaacaacgagctcctacggcagatgggaataagatatgaagaatccaaagagatgaggatcaatatgatccaaaaagccatccacgggtctagaaaaacctacgaccaccacagaaattttaacaatggttaaaatggcaaaaagatatttcaagatgaattgtggactcatctaaaaaatgaccaccttgagtccaaatatgcctagctatcatggttgctgatggaaacagtaaggcacctgatagctaacttttcactgtgaatatcttcagatattcacagtgacacgaaaggacaccactagtaaaaaccactagttttttctgacacctcttgctacaaactctgtaaaaatcaaaaggatcgataggccgcgctttcacggtctgtattcgtactgaaaatcaagatcaaggaagcttttccccttttagtcaacaccaggtttctgtcctagttgagcttcccttgggacatctgcgttaccatttgacagatgtaccgccccagtcaaactccccacctgacactgtcctcaaaacagttcaattgcatccgaagatcgcaattttttcactaaaataaattaacaaaagttaattatactgcttcattgagtaagtagaaaaacaatc

SEQ ID NO: 1046 - DNA, 6343 bp, Caenorhabditis brenneri
  modified_base (1436)..(1436): a, c, t, g, unknown or other
aaggacgctggtttaaggccgaattcgttcgttctttttctggcggtcttgctttgagcttggtttccgatcctatgcccttgwgcatcagcgattgcgttcatctggtctcggccgaaggagatacgatgaacgggaggtccacttgtgggccattgtctcgttcatcctctgtcgtaagtaggtcgaggtcttccccttcccccagtgttcccccccacccttcccccagtatcggtccagatacaggattgtcggctggaatcatcggcacatcgagaggatgtagcctttggttgccagaggtggacaatgccttatcacagtggctgagaaaagggttggaacgagaccatgaagttctggtttgtggatttgaggcagcaaagccactgtcactttccaaagctagacttctaagaaagaccccaaggaacactggtgtggttaggcacatattagaatttgacggaaggttagttcatactaactgtaacgagaccgagtgtgttctttctactttgtkcagtgamgwggctgtcgaagtagtcaggatatctctcaaatgtgaaccccgtgaaccctgtgaacccaaatgtgttctttctattttatgcagtgataagatagtcwggatatcatttgaatgtgaaacwcgtgaaccttttcctttcttcmcggatcggaaattcagagaacctattcctttcgttttcgagaggatgtatgacccaagagaccctattccttcatttatttgttggatgtatgacctgagacaaaggatgacccctggcacsttgccaagwaatcccctttctcmagagaacaaagacagctggggacgcccagctgtcataaagaatgagataagatctatgagatcttatctcgaagagaatgtgaaggaaaaccgcctgaaccttttgagaaggttaagaggtggtggtgaaggaaagaagatgatcagaaagttggttgcagaaaagaaaagcgacacagaggctgtctgcaggatactgtacccacttgatgatcgttatgagtgttttgttgatggttgtgagacaacatcaacgatgggatacgggtctagtgacctgaaatacatgaccacacacataaagaaagagcatggtgtgaaagtccaatggacatatgagtgctccctgtgtaataagcaagctcctttcatggggggagctgcgtccaagtgggttacagcgcacatggcaacaaagcataccgaaacggtgaagttgaagctcaaaccaagcatctcgactactgccaaggttgctgcgaagctagatgagatcgccgtgtcgctacccaaaccgagacaagtacgtgtattgagagacccagatgaagtgaaagagaaggttgcaaaaccaacacttgcttccacgagagaagaagtgaagagaaatgcnttgcgaaacatggccccactagtcgaactgagttctcagaatcagttgacwggagccgaaagacctgaggaaactagtgaagctatgcgactcgaggagtgtaggactccagagaagattgctgaactagaaggaaagatacagacccgaacagtgactaaaaagcttagtgcactgaaagagtcaatggaaaagagaacgagagaggagaaggttgggaaaccatcacttgctccaattcatgaagaagtgaaaaagactgcaagacggagcttggcacctctagttgaaccgagtacgttcactcatttgactggggcgtcaagacttcaggctgttcgtgacgcgttctcgaaagccaacaaagacgctgcggcgaaaagaaggtctagcctggcgaaaccagctagattatcagagattatgaataccaccttcacgaaggagacggtaaatgagacgaaagaacctgtgaatgatactgacgagagtatcgcaacaatccagccacaagtacgtgtctaccggtttaatacatggtgtctcgatcatgaaaccacgagagaagcctggttaaccggagaagttgtggattggttcatgggaaaagtgactgagaagaaagaccagtacagagtgtttgactcacttgtatggtcaatgtacaagttccatggtgtagggtatgtattggatctgatgagggatcctctaacatacttcttaccaatatgtgaacacgatcactgggttttgctagtgattgatgagaaaggaatttggtacggtgactcgaaaggtgcagaaccgtgtagagaaatcgccaaattcatagaagagacgaaaagagaaagacgaatgttcccagtccccgtacctcttcaaagagacggagtgaactgtggtgtacatatatgtctaatggttaaatccatcgtgaatggcgaaccatggtacaccgaagaagaagtgaaagtgttcagaagaaatgtgaaaagaggtctgaaagaatttggttttgaactttattctgaaaggatcgtctatgtcggagatgacagcataaaagtgaatgatgagcatgatgatgacgtggtattcctctcggaggagacgaataacactacgttcacgatcgagcaagcagaagatccggctgaagaggatgcccagcatctggagagtccggtgaaacctgtaaagctcatggagttgaaaattccaaagattgagataaagaagaaagagattcggagaaaaccgaaacaacaaatcgaaaagaaaagaaaggtgccaacagggaaaccagatgaactgttggtcagagtgcgattatggttggaaagagaagtccaatcatacttcgactctggaaagagattccaaagactggagtggatattagatgtcctcacggctgcgattcacaaggctaccgccggtgatgagcaagcaattgaaagaattgagaagagatcaccccctttggaagtggaagagggtgaaatgtctacacagacagaaccaaagaaaagagaaagaaaagaaaaggagtcaggttgtgaaatgaaagcttctcacaaggagatgtacttcaaaaaccgctccaaagcgttcaatgtgataattggaaaagactcaaagcaatgcgagattccaattgagaccctgcaaaagttctttgagggaacaactgcagaaacgaatgtgccagcagaagtgctgaaagagatgggttcacgtctgccaaagttggaggcgttggactggatggaagctaatttcattgaaagtgaagtgtcagatgcgatgaaaaagaccaaagacaccgctccgggtgtagacggactacggtatcaccatttgaaatggtttgatccagagtataagatgttgacacttctctacaatgaatgtaagaaccatcgaaagattccaagtcattggaaagaggcagagacgattctcctttataaaggaggtgatgaaacgaggcccgacaactggagacctataagtttgatgcccacgatctacaaactgtattctagtctttggaaccgaagaattagatcagttggtggtgtgatgagcaaatgtcaacgaggtttccaagagagagaagggtgtaatgaaagcataggaatccttagaacggctatcgatgtcgctaagggaaagagaaggaacctgtcagttgcatggttagaccttacgaatgcgtttggttcagtaccccatgaactgataaaaagtactctggaatcgtatggattcccagaaatggtgacagagattgtcatggatatgtacagaggtgcatcaatccgaatcaagagcaagaatgagaaaagtgaacagattgttatcaaatctggagtgaagcagggagaccccatctcccccacgctgttcaacatgtgtttagagaatgtgataagaagacatctggatagtgcttcgggacacagatgcataaagacaaaagtcaaggtcctggcttttgcagatgacatggccatactggccgagaacagagatcagttacaaactgaactaaacaagttggacaaagaatgtgaatcactaaacctcattttcaaaccggtaaagtgtgccagtttgataattgagagaggaatggtgaataagaatgcggaagtggttctgagagggaagccaatcagaaacctagatgagaatggttcctataagtacctgggagtacatacaggaatcgcaacaagagtttcaacaatgcaattgttggaaagtgtcacgaaagaaatggatctagtgaatcagagcggcatggctccgtttcaaaaactagactgcctaaagacgtttgttttgccgaaactaacgtacatgtatgcgaacgcaatacctaagttaacggagcttaaggtctttgcaaacttgacgatgagaatggtgaaagagattcatgaaatccccatcaagggatctccgttagagtatgtacagctacctccaagtcaaggcggattaggagtggcttgtccaaagataacagcgttgattaccttcttggtcaacgtcatgaaaaagctatggtcttctgacagttacatcagaaaactatacagggactacctggatgaagtcgcagagacggagacaggtatggaagagatgacgaaagaagatattgcaaaatatctgagtggtgatgtgccgatcgacaagaaggcgttcggttacaacacmttcacaagagtaagagatgtgtgcaacagcctcactaasatagkgggagctccactgcacaagttaaagattgtggagagagacggtgactttgccattctagtgcaagccaccaaagaaggaatggagaaaatcttcacctgtgctcaggagaagaaactccaacagcttctgaaagcagaagtmaacacggctctagcgcaccgtttcttcaccgagaaaccmgtgaaaagtgcagtgatgagtgtaatgagacagtatccacagagcaatgcctttgtgaagaatggaaagaatgtgagcattgctgtccactcgtggatacacaaagcaaggttgaatgcgctgcattgcaacttcaacacgtacggtgaaaacaagtcaaaagtgtgccgacgttgcggcaaagacgtggaaacccaactgcacatcctgcagwcatgcgagtacgggttaccaaagctaatcaacgaaagacatgatgcggtgttacatgtggtgagaaacctcatccgcaaaggctcaaagaaagactggaagctaaagatagatgaaactgtgtcaagttgtaatcaacttcgtccagacatctatatgtgtagcccagatgggaaagaggtcataatggcagatgtaacctgtccttatgaatcaggaatgcaagctatgcaagagagttggaaccgaaaggtcacsaaatacgaaggaggctttagccacttccawaagatgggaaagaaattcacagtgttgccaatagtggttggatcactgggaacgtggtggaaacccacaacgaacagcttagttcaactaggcatagagaaagasacgataagaagagtgatccccgagctgtgctcaatgaccatggaatacagtaaggatgtctactggaaccatatattcggggacaccttcaggaagccaccaatgagatttggtgtagagaagccaaagggtaatagttggaagaaggaaggcagcgagccgaaaggtgctgcttcctccgactaaacccacacgagamctacgacgccataagatcaggcatgtacggatgtgaatgagactgatgaacggaatgagcacgtgcccataagatcgggtatkaaagawcagagacgatccctamcatcgggaaaacacgagttatactgcttcactgamctcgctaagctctcataatgaccgaacttgttcgcaactgcctcctaaccgggcgggtgtgagaagggaggtcgccttgaggcggacgcaatgagggatgtgtgcaggttccccctcttgagatccgaaagtctaaaagtactagaccgaaagatcgaggacggacgggatggccgcgaggcacacggcgggtaacacagccagataacctagtagatcttcggatctcgtcggcctggagatatgtggaaccctgggaaaggagaaagttgtttgttgggctggcaagagtgaagtttgaatgtgaaccaccgtcatgcaaccactaaaccagtggcgatgcgggtggagtcatcacaggaaaatgtttctgttgcttgacttatcagtgtttgatatcgccctcaggcacaagtatgaaggcccccacccacataaactccctagcaactggtagtccagcaagcgctggtwcttgctactattgcgccccaggctcgccc

SEQ ID NO: 1047 - DNA, 7751 bp, Caenorhabditis japonica
gcgccccgggttacattgtcggggccacctttctcttggagtagagtacagtctactaattttttgataagctagtcgggtccgaaccactagagtttgcttgaaaatgcgtcaaaccagcattttagaactcgcccaaaagttcggccccgacccccaaacaaatgggaccttcttgacgattttccctgaaaatcggaggatggaatggtcccctattcttgtaaatagkactgtgcaataccccttcgtcatctgtggggaacagatgacacgtgacgtcatccgtgtagacgtcacgttttcccgtgcctgcgggagcccccaatcgagcaatttttgctcttttgagtgtctggaacgcttgaaaccccagacaaatcaggcccagtcgtcggaaaatttctttttgaaattttttggcgcctgcgaaaaaaattttttaaccgccacaaacccccgggaggcgcggwtagggatatcgatgtcatcgactcgtcggtgatctttgattttctctctgcgtctcctattttggaacagtctcgaccaaaaaaccgggcctggcaacccaccgaatccggatgtcggagggatttggcaagaaatgttggaaataacgaaatttcgttattttcagcacaattgtcaaaccggcaagaaaactggatggacaagacacacaatttaccggaaattgtgcttgttacgtcgaatttcccaattttgaaaaaattcctcgttccactggtcgggacgcgaggtcagacgatctgcacgtctgaaacccaaaatcttcggattttatgcagtagtggcgccgcccggctcccaaacaaacaaaaaattcctcgttgcaccatttggggcacgaggtcaaacgaattgcacgtttgaaacctggaatttttgaattccatgcaaaaccaaaaaattcctcgttgcaccatttggggcacggggtcaaacgawttgcacgtttgaaacccggaatcttcgaattccatgcaaaacmaaaaaattcctcgttgcaccatttggggcacgaggtcaaacgaattgcacgtttgaaacccggaattttcgaattccatgcaaagccaaaaaattcctcgttgcaccatctggggcacgaggtcagacgaaattcacgtctgaaacccggaatcttcggattctatcaaaaatcaaaaaattcctcgttgcaccatttggggcacgaggtcagacgaattgcacgtttgaaacccggaattctcgaattccatgcaaaaaaccggataaaatccggtctaaaagtgacgtttttgtcagatcttwctgctcacgctggtgcgttggcgtgtagcagatttctggcatcgacacttaaaacggagcactgccgacaaaaaagcttcaagccagtcggttttctgcttcatttcctaaaaaattcctcgatcaacgaggtggcgtctctccgcaacgtcaaaaaaawktttcttgaatttttctcaggaaaacctatcggtgggatggcttctttcagtagaaccaaaataacttttttcaaactttgtttgaagaattttgttttgtctgctgaaaatcccccgataatccgccaaaaaacaaaccaaaacaaagcgagccktgtccaaatcgcaagaggaggtcatctgtcagactgtctkccgtcccaaaagatggcaggagttctcggacgactatttctctcggttcagagcactctctcgcaccgccctttcgacacgttattgcggagcgatgacgacaaaagagggaggaaaacgatcaaactccagttttttattaaagaaaatctggtcacacctktggttgctagggacgtgaaaattttaaamaaacaaacaaaaaacaattctgggaactctgatagcaacagtgaaacaaaaaacttctctaaaaataaagtttccagacaaaatggcccattgattgggggcggtaaccacaaaaaaatcggagaaaaccaaatcacacgcactttggaaattgaatccaaaagcgatgacaacaaagttttggtcctccgaatactgtacccaactaatgattggtacaagtgttactcccaatggtgccaacacaaatcccttgttggatatggcgctcacgatttaaaatacttgacagaccacataaagtccactcattctaaaaaggttgagtggtcttatcagtgtagtatttgtgacgcaaaagccgaaggtaccggtacaaaagcwgctagatggattacagcccacatgccaaaagtacacggtattgaagcaacacacagaattaaacaaaattctgaaaaaacaacaaatgttaaaactgcgaacagtctccaggaaatggcgctgtcgctccaaaaaccaaaaaatggtccgaaaaaagttgtaatggcaactagtacgaccccagaaaagaaaatctctgaactggaatcaaaaatccaaaccagagaagtggccaaacaattgagcgctctgaaggagtcagctcaaaaaaatcagcaaggaaacaaaacaaaaaatgttaaatcaagcttaaaaacaattgctgaaaacacaaatgaaacmaaaaagatwagcgctcgaaagagccttataaactatctgaaacctgaggatgtgctcaatcacattccaaaggagccaaaaccagcttctgcgaaaaktggcctkcaagaactgactggtgctcaaagactgcaggaaacmagaagaaggtttatggcwggaaacagaagagattcaattgcaagaagagaaagtctgtctctcggcaaaatctcaaactcatttaaaattgagctgaaaaatgctccggaaaaaacaactcttaaaaaaccggctgtcactcagaaacaaaacacgagtcagaatgtatctagttctacggttgtaaaagagaacaaaacaggaaatgacgtgatcacaattgatgacacagaaactgttaaaagaaaaataaacacttggtgtctcgaccacgaatccacagaaaatgcgtggatggctgacgacatcatattctggtacatccagaaacagattgaaatcagtttggacaataaaaagttcaaagtgattgatccactcatctggaccacatatcgaatttatggtgtcgaatgtgtccaagatgaactagttggatttgaaaaatacttttttccaatctgtgaaaatggtcattgggttttgctgattatcgatgacaaaagagtctggtacagtgattccctggccgataaaccaattgaggttattgaggacctcataaacaaactaaatcgaacccaaggtaaatttaaccaaacggttccaaaacaaaaagacggctttaattgtggagttcatgtatgtctggtggccaaatccgttatcactgagaacttttggtacacagaaaaagacgttaatgacttcagaaaaactgtcaagctttggcttttcagtgaagggtttgaactctattcagagccgtacaaacaaatccaaaacaaaaacatttccgttaattcggaaaaaaatcaaatcagtgataatgaaaaaaattggggtgataaaactcaaactgtgaatgagagtactctgaaagaaagagatgaagacatctttttgctcagaccacacatcagtgttggagttgctctcaagacagaagacgagaaaaatcaaaaagctgaaaacttgaaagccccacaaaaactctgaaacacggaagaattccaagtggacaaaaacgagaaaccagaatctccaaatgcccaggaaactccaaaaaacgagccaaaaatggttccaagtccgaagaattcggaaaaagaaatttctactgagcttctggatgctcaagaagccggagaagagctgaaaagcgatccgaaggctgaaaatcctgaaaacctgtctcaaaaagctgacggcagtgaagggaaaaccggaagagacggaaagagccgccattccaaacctcatggcaatcaagctcaagacgcctccaaaagttgaacctgtaagaagaaaccctgaaaagggtgaaaattacmaaaaaagtcagccaaacaaaaagagacaaataccaaccggaaaaccggatgaattggttaaaaaagtccgagaatggtttgaaattcaatttcaagcatattttgaggacggaaaatccttccagaggttagagtggwtgacaggtttgctcacggctgcaattcacaaagcttcggctggagatgagcaagctgtgggmaaaatcatcaaacgttgtccacctctggaaattgaagaaggggaaatggctacccaaactgaaacaaaacaaaaaccaaaaaaccaaaagagcacaaaaggagcaaatagttccagctcaattcgggaagcctatgctgaaaaccgagcgagaaccttcaacaaaattattggaaaagacgacaaatagtgtgaaattccaattgaaaaaattgaaaagttcttcgagaacacaacttcaaataccaatgttccaacagaaacactagcgaggatcacttctgatcttccaaaactcgagattggtagttggattgaagaagagttcagggagaaagaagtagccgaagctcttaaaaaaacaaaggatactgccccaggtgtagatggattacggtaccatcatctgagctggtttgatccaaaaakgaaactgctcacaaaactgtacaacgaatgcagggagcacaagaaaatcccaggtcactggaaagaggcagaaactgtactcctctacaaagggggggacgagacgcaggccgagaattggcgaccaatcagtctcatgccaaccatctgcaagctatactctagcctgtggaacaaaagaataaaatccgtgacaggtgttctgagcaaatgccaaaggggttttcaagaaagagagggttgtaatgaaagcattgcaattctcagaaccgctattgaagcggcaaaaggaacaaaaaagagcctgtcaattgcttggttggaccttaccaatgcatttggctcagttccacacgaatcgatcgaggccacactaattgcttacggttttccgggaatggtaaccgaggtaataaaagacatgtataatggcgcatcgattcgtgtaaaaacaaaaaacgaaaagagtaaacaaatcctgattaaatcgggtgtaaaacagggtgatccaatctcacctactcttttcaacatttgccttgaaagtgtcattmgtcgccacctaaaaagcgcggatggtcacaaatgcatcgamtcaaacatcaaattattggcgtttgccgatgacatggcaatcctgtcagattccaaaacaaaactccaacaagagttacaaaaaatggatgatgactgtacaccgctcaaccttatcttcaaacccgccaaatgtgcaagtctgataattgagtggggaaaagtacaaaaagatcaaaaaataaaactaaaaggtcaattcatcagaagtttggccgaacaagacacctacaaatatcttggggtgcaaactggcatcgaaacgcgcgtttctgcaatgcaactgatgaaaaaaackgtcagcgagcttgacaaaataaattgctctgcactggctcmwtggcaaaaactggacgcagtaaaaacttttgtgctcccaaaaatgacgtacatgtatgcaaatactgtaccgaaactctccgagctcaaagagttcgcaaatattacaatgagagcaataaaagtaatgcaaaacattccagtaaaaggttcaccattggagtatgtacagttacccattggaaaaggtggactaggagtggcatgtccaaaaacaactgcgttgataacctatctggtttcaacaatgaaaaaattgtggtccactgatgactatatcaggaaactacacacagactacctgaaaatggtggccataaaagaaacgaaaacaaaagaggtcacactagaggaccttgcctcctacctaagtgatgataaaaccgtctgcaaaaaagcggttggttataattcattcacaagggtacgagaaatctgcaaaacgctatcaaaaaacaaaggagcactgttaagccaactaaaaatcattgcaaaagatggaaagttggctattctggtacaggctstgaaagatggcaaaacaaagattttcacgcatgaccacgtgaaaaccttgcaaaaasttcttaaaaaagaaataaatgaagcccttctgcacagattcacaactgaaaaaagagtgaaaagcgaagtggtgcgagtggtccaagagtacccccagtgcaactcctttgtcagagatggaggaaaagttagcattggagcgcatcgctttgtgcacaaagccaggttgaacctgctcgcgtgtaattacaacacgtggcaggatgcagccacaaaacaatgcagaaggtgtggatatgaaaaagaaacccaatggcacatcctctcatcttgcccaaaaagtatgggaggaaaaataactgaaagacacgattctgtgttaaaaacagtaaaagagatgattcaaactggatctctcaaaaactggaaactaaaacttgatcatgaattgccaggatcaaccagacttcgcccggatatctatttgagaagcccaaatggatccgaaataattcttggcgatgtcacaatcccgtatgaacacggaattgaagctatgcaaacagcatggcagaaaaaaattgaaaaatatgaagagggcttcaaataccttcgttctaccggcaaaaaactcacaattgtgccaattgtggtcggagcactaggaagttggtggaagcccacaacagacagtcttgtcagtctgggaatcgacaaaaatactgtaaaaagagctattccagaaatttgctctacagtactcgaatacagtaaaaacatttactggaaccatatattcggggattcctaccaaaaagtacccatgtttttcggcggtgaaaaaccaaaggggcaaagttggaagaaagtgaagcctcctgaaggcaaaactgcttctaaccatgagcctccaggttaaaagccaaaagccacggagcatcgggaaagaaaaatggaaaaggactgaaaacgagactgaaaaatcccaaacaaaacaaatccaaaacaaactgaaaaaaaaaaaaaaacaaaacaaaaactggacagacactggaaacagtgtcaggcaaagtcgccgattatactgttccacgccttaaaagtcccgaaatggcgcaaaacaacctgaatctatctgaaagtgctccaaaccacgcacaactcggagaaaatcagggacaagttgcttcacgcaacgggctgggacaggtaccccctcctgaaaccgcgaggttgaggatggacgggaaggccgcgaggcttatggcgggtaactcggttggtgtgctagtagatgatttatatccgacagccccaactaagaggaatcctgggaaaggaaaacttgaaaaagtttttacagggctggtaatagttcagcacaattgtagtctactgtcttgcaaccacaacaaaccagtggttctgcgggtagatcaaactataatttgtgtgttttcttttacttgacccgggcaacacattataccacgtccacaaggacgaattcataatggcccctccctaaataaactccctagcaactggtggtccggcgaagccggttcttgccactattgcgccccaggctcgccc

SEQ ID NO: 1048 - DNA, 6064 bp, Caenorhabditis remanei
cgcgaaccagtcatatgacagtctttattgatcgcggtataggcgagcgaggccagatggccgtatgtagcctccaccgttatttttcgttttcacctttttcccccatccccccgtatgtaaataatggatcgttcggcgaaaatggctgtggcacagacaaatcactgttgcccgtcatagaagttgttgttcgtgaagttaagataaattggtctgagaatattttggtagtagagtgtctgataatggtaaagagcggagaaagagtcgttgtaaagagacaaaatctggaaaaagttattcagaatttggcaagaatcaactcaactctattttccaatctaggaaatcagatattttgcgtagtacccagaataaaagacagtaccaataaagagcagggatacaggaaagagaagcaawtgaaattccatgtatcattccgaagtataaaatcccaagttccaccatatttgagaggtgggggagatgtaatggaagatacagagataagaggtatcagaaagttggagccagaggctcagttagacagctcaaaaccgctgatctgcagagttctctacccaacgcaaggttatatgtataaatgtttttatccaaagtgtaaaggacatagtaatggatcaacagatctgagaagtctgaagaaacacatggtggataagcatttcacgaatattgaatttgcatataaatgtgctacgtgtatgtttttaacgactgggaaatcggccacagcgttaaaatcaataaaggcacatatggcaagtcaccacaaggtaacgatggaacccggtaaaaagagtctcgtgcaaaagttgaatgccagactcgaagaagctgctccatcacttccaatgccgagaaatcgatcaaaggtcatacagttgacccccgagaaatcgatatcggaattggagaaaaagaagcaaactcgttctgtggcaaaacagcttagcacactgaaagagtcggcacagaaaaaggaagaggaggtgaagatagcggaggtcaaaaagagagaaccccgtctatcaataatcccagagtcgaatgtcaggcgaagtctggcggcaggactcgaacaatgtataaaccctgagcaatcggtagctcagaggataagagaaaaaagagaagaatacgccaaagcttctagggaggcagcggcaaaaagaagatcgagtttggcaatgaagccagctagattaccagacaaagaaaacgagattacactccaggaaacgaaaaagatcgatgatccaatcgttatagacctggaaaaagaatgtattctcactacagtacttcaagtcccaagaaaccagttcaactcgtggtgtctagagcatgagacaacgattgacgcttggttaacggatgaggtaatacatatgtacatgtgcacaataaccgagaatcgaaaatattttatggcaatcgatccggttctgtggccagtctatgtgagaaatggagcagaggatctactgaggcgtactagttgcccaggaacattcttctttccaatttgtgaaagtaatcattgggttctattagtgatagaacacgatgtgtattggtatctggatccgaaaggcgaggaaccaaaaggaaatgtagagattcttttagagtccatgaaaaggaaaaggcagtactatgaattcccaccaccctcacagagagataatgtgaattgtggagtgcatgtctgtcttatggcaaaatcaatagtagatgaatgtggttataattggtattctgaagaggacgtaaggtcattcagaaccaatatgaaggacattctgaaaagtaagggatatgagttatgtcctgagccttataataggcaaaatttattaaaaacagaaaaacaaaaggaagttattctggaagaaatgatcgattcattcgttgtagaagacgatatgacgttcacagtgcatcgggattctgatcatggtgatgatgaagttgaacatctgaagaccattgagcaggaacctgaaaatgaaataagtgaaattgagaatgtagagggatctgtagactcagtcattccaaagttgatggaaatgagagtgcagacacctccagtgatcaatgaaaaaagaggtaaaaagcgagtatcggccaaagagaaaccgagaaagcaaaaggaaaaagagcaaaaagtgccaacaggaaaaccagatgagctggttaaaagagtaagagtatggtttgagaaagaattcaaatcgtatgtggaagatggaaaaagtttccaaaggttggaatggmtaacagatgttctcactgcagcaattcagaaggcgtcagccggagatgagaaagcagtagaactgattgagaaaagatgtccacctttggaawkcgaggagggtgaaatgtgtacccagactgaaaagaaaaagaaaccaaaaagtggtaaagggaatggcggtcaagaaagtatgaagtccttgatggcctcatacagtgagaaccgagccaaaacctacaatagaataattggtaagcattcaaagcagtgtgagatcccaatagccaaagtacaaaagttctttgaagggaccactgccgagacaaatgtgccaaaggaaacacttaaggaaatgtgttcacgcctcccgaaagttgaagtgggaacgtggattgaaggtgaattcagtgaaagtgaagtgactgaagcattgaagaagacaaaggacacagcaccaggggtagatggattaaggtaccatcacctgaaatggtttgatcccgagttgaaaatgctgtcacagatctataatgagtgtagagaacacagaaaaattccaaagcattggaaagaggcagagacaattcttctctataagggaggagatgagtcmaaamcggataattggaggcctatcagtctgatgccaaccatctataaactgtattctagtctctggaacagaaggattagagcagtgaaaggggtgatgagcaagtgtcagagaggtttccaagaaagagaaggatgtaatgaaagtatcggaatattgagaacagccatagatgtggccaagggcaaaaagagaaacatagccgtagcatggttagatctcacgaatgcctttggatcagtaccacatgagctgataaaagaaactctggaatcttacggatttccagaaatagtagtagacgtcgtagaagacatgtatcgagatgcatcgatccgtgtgacgacgcgaacggagaaaagtgatcagattatgatcaagtcaggagtgaagcagggagatccaatctcgcctactctcttcaacatgtgtctcgagagtgtcatcagaaggcatctcgacagatcagtcggccatcggtgcctgaaaacaaaaataaaagtattagcctttgcagacgatatggcagtattagcagaaagtagtgaacagttgcaaaaggagttgacagctatggatgctgactgctcagcactgaatttgctattcaaaccggctaaatgtgcaagtctgatattggaaaaaggaatagtaaacaggttaaatgaggtagttttgagagggaaaccgatcagaaacctcatggaaaatgagacctacaagtacttaggtgttcagacaggtacggaaacaagggtttccataatggatcatataacggaagtgtcaagggagatagatctagtgaatatgagtcaactggcaatgcaccagaaactagatatactcaaagccttcatacttccaaagatgacctatatgtatcagaacacgacacctaaactgtcagaactgaaagtgtttgccaatttggtaatgaggtcagtgaaggaattccacaacattcccctaaaagggtcaccgttggagtatgtccaacttcccgtaggaaaaggaggattaggagtggcatgtccaaagaacacagccttattaacattcttggtaaccattatgaaaaagttatggtcatctgatagctatatcagaaagttgtatacagactacctagaggaggtggcaaaagtggaaattggaaagttcgaggtcaacttgaacgatctagcagaattcctaagtgacgaaagagcagtcgacagcaagttgttcggcttcaatgcgttcacgagggtgagagaagtggtgaggagtctctgtaagaataaagattctccactacatagtctgaaaataattgaaagagaagggaaacttgccataagtgtgcaagcaaccgaagaaagtattgagaaaatcttcactgaagaccaggaaaagaagttaatgtacctactgaaaggggagctaaatacagctctccagcacaggttctttactcaaaaggtattcaaaagtgaagtaatgagagtggttcaacagcatccacaaagtaacagttttgtcagaaatggtggaaaaatgagtttttcggctcaaagatttgtccacccaggaagactgaaccagttgccatgtaactacaacacttgggcaaaaggccgtacgaagttgtgtagaaggtgtgcaaagaatgaaaatgagacacagtcgcatatactgcaagtgtgtgactactcaataggaaatatcataaaggaaagacacgatgcagttctttataagtttagagaactcattaaaagagggtcaaaaggtcattggttagagagaactgaccggacagtaccaaatactggatcacagctgaagccagatctctatctggaaagcccagacgggaagcatgtgatactagccgatgtgacagttccatatgaaagaggcatcgaaggaatgcaaaaggcatggaatgagaaaatcaacaagtatactgatggatataaagaaatattcagaagacaaggaaaatccctagtagtgttaccattagtagttggttcactgggaacgtggtggaagcccacggaggaaagtctgatcaaactaggtgttgagaagactacagtaagaaggataatacctgagacgtgtggaatggtggctgaatacagtaagaactgctattggagacacatctacggtgaaaagtatgttcaaactccaatgataaatggaggaaaaaagcctgaaggaaatgattggaaaaagtgtgaaaaaggaatagaagttcctaaagttactaattagccgatcgtaaaagaaaccgagccgtaacaacaagcaaagtaaacaaaagaaaaatcaataaaaaggaaggttgacctcagaccccgaggagggaagagagacaccsagaaaaagagagacgcagagaaaaggagagacacctctcataaggagaggtaggtcaatccaaatgtaaacagaaaaaaccagtggggaggaaagaaagactgatttcacccactaaaatgaatttggaaacagaatttggaagagaaaagagaaagggaaacctaaagaaaatagttctcttgccaaaattctgtagaggaatactttgtcaaaacatgatagaaaccagtaatctggtacgaaagacaagtaagacctgaactgacaagaaggaagtcagaaagaaataccgctcacaaagcctgtgatcgattctcttacctactgaacttgttctcttggcctcgtaaccggctaaagggagaaggaatgttaattggagatagacataaagataggtggagtgaaggtcctgttcttgaaactaggaggaatgtggaaagagcagaaggccgcgaggctttagacgggtaactcagtcagttgctagtggtcttcggatccaacggcttcggacatagtgaggaaccctgggtacggagaagaaatggaaaagagatagggcgggcaaaggctaagttcatacactgtcatgcaaccactaaaccagtgggatctgcgggtgaatcactttcgaaaagaagtgaatggacgtgctgatgtctgactttaaagaagtctgaaattaaaaaaacagatataaaggcccctcactataaactccacagcaacaggtggtccggcgaggccggttcttgccaccattgcaccccaggctcgtc

SEQ ID NO: 1049 - DNA, 6092 bp, Trichomonas vaginalis
gggtgagtagtctagtggtatgattcctgttttgggtacaggaggtcccgagaagcttccactgcaatcgtacgtgtactgtggcaacacagctataacagacagtttcacgccaaccgcgaaaacgattttgaagcctgaggaacaaaatttagatatcgttttgaaaaatattgcagcgttgaatccagaaaattactccgacttaatcaggagcctatcgaagatggagttcagattagattacccgaaagaaatagagaattactggatttcggaaaaattatttagccaatccatcgcatcattgcccatcagtttgttagtcgcatccatgttctcacctgaagaccgtgacttgagtacagaaccgttccactgtaacgctgatggctgtaatttccattgtgacaattgtgaaagaatggttgaacacatcagagagcaccataacactgaccccatgatcaatacatttgaaacaacagaagacacatttagaagaataacggccatcaaaatagacaagacaggcatcgaagaacttaaccctctaaaatacagatgctcgtattgcgacgagttattcaccgaagcagaagatcatgccatccatatgatttcacatctcacagaaaaattatcaccagatatatctttctttttcaacgacattttacgcctttacaaaactatcgacaaaccaacagtacaaaatttatttccagaaacacaagtcgcaatttttgacacacttgaagaaacaaacagattcagacttatcgtaggaagagaagccatagaaacaattgaagaagcattccctccaagtccaccaggaacagatcggaaaccatccataatcatcacagacacctgtcaactcaggtttgtaccatgcatggatgaaccaccaaaaggagatctcggaattctgactctacttttaagagatttcagcgcacacaatatcccgattaaatcactgaacaataaggaactaattgctgataaagacatcgattacagcccagattttgtcgaaggagctctagccaacgcagaagaacatgatacaacgaacagccagaacaacaatggaagatacattaactcagccgaaaaacttacagaatttttaatacaatgtgaagactacttaacgaacatcaaaacacttgaagacttagaacgtttctacacaacgattaaagactacagagtcaacaaagaggttatcgccgaagatacaccaatctttgtatatttcctagtagaagaagggaaattaccaaaaccaggtcttagatgcccacttgaatcatacgaaggacacgaagacaaggcattcgaatcactgagaaaactttgcgaccacttcaaaggagaaatcgcgaaaacgagctttgacccaaaggttcacaccatagacatctgggttgaatttttggcccaagcctatggcacaggcacgtttgtctacaaagatgaaaacggaaacatcgaccttgatacgcacgtattcaaatgcccttatgcagactgctcatacacgaacaacgacagatcaaaactcatggaccacatgaaaacgaagaaacacgccaagaacgtatacatcgagagatacggcttcttttggggtattgtcatagaaggagtcaaccgaccaaaaggaatcgtctacccgacactcaaagacatcaaagaacacgcttgtcgcaaatgtccagaagcaggatgcaacacatatgtaacagaattgagcgacatcaaagaacatctaaagaagaaacataagtctacaacagcaggagtagacggagaaatcgcgcacactgatgctacatactgctggattaccaaagaagaactcgacgcattacatgccgagagagcaagagaaagagcagagcaagtagacaacactccagtacaacagataattaatgctgacaacaatgaagagaacaacgagaaccaagaagacaacggaaacaacgaagaagcagatgccctcgacccgccaaataacacaacagagacagaagatgaagcggttcatgccgtcatcatcaatccaccagcaacagaagaggaagaggtagccatcatcgccgaggcaagaagaaacattccagaactccaacaagcagaagagagaggctgcgttacaccgaaaatgacatcactcgtccgattaaaactattgaaaggaggaggagaacttttcaacaagaaactcactccattagccacaagatacgcagctacaggaaatacagaagcagacaaaatcaaggtagattacttgacactaaaatgcaatgccgccttgagagaaatgatctacaccaataaccacagcgaatcaaagtttatgacagcagaaaatggagaagacacagcaccaccgccaaggatatcggaagacacaagagatcgcattcaaaaagcagccaatgaaataaaaggaactctcatcaaagtagtcaaacacataagtcacgcgagatgcctcaaagacagcacgagagacgatgaacacaataaattcgtcgaaatgattgcaaaaatcaaaaacgatctcagagataacaaattcgaacaatataacattgaagaaatatttcaaggaccgatctccgaccagagtattctcaacatcgtcaacacggaggacaacaacgaattcatcaagaaaatggattacattaaccgaattctcggaacaccacaggatgcatcaccatatgcaaggaagaagttacaagcatgtttcgccgataacccaacaaagactctcagaaacataatcttagccgacaaagttccacaacaatcattgaagccaagcgaataccttgattactacggacctcaatgggcaaacgaagctgaaggctacgaaaacttcctgcatcatgactacgcgttaccggagagatatggccaagttttcgcaaacgacttcctcgacttcatgacaaacgaatcgaagatcatcgaagtaatccgcaacaagaatcatttatcggcacacggcctcgatggaattccgaactcagtttacatgctattcccagtcagcgccgcaaaattcctcagtatattattcagatcaatcatcatatcaggtcacatcccagactgctggaagctctccaagacagtgatgctttttaagaaggacgacccatcgttagcaaagaactggagaccaatcggcatcacgtcatgcacttacagaatcttcatgactttagtcaacaaagcgttacagatgatcccaatgttccacgcaatgcaaaaaggtttcgttcgcggagcaacactgagtgagcacattgcagtcgcgaacgaagtcctttgccaatcaaccagaacacagtctgaaatgttccaaacagcaatcgatttcacgaacgctttcggcacagttcctcatcaattgatctttgattctctcgaagcgaagaaagttcccgattcgatcatcaatctgctcaaggacctctacaaaggagcaagaacggctatctatacaagacatgcacactccgagatagttccggttcgcagaggtgtcatccaaggctgtccactcagtccaatcctcttcaactgctgcttagatcctttattatatgcagtccagaggagacactttgaggacggttacagattccaagacaaagcaggacagtattcaattgccattcaagcttacgctgacgacgttctagtcatctctccaacacatgaaggaatgcaaagaatcttaaacacagtagatgaattccagaaaattgcgaaactcaaagttgcaccacagaaatgcgtcacacttgccaaaacatccactgcaatccaacctttccgcattggtccagacgaaatcccaatcaagacgagcatggacaacatcacatatcttggaataccaatctctggaacaaagacatcaagatttgcagctgcaactggcattctggaaaaggtcaaagcacagatcagagtcgtcttcgcgtcacatctcgctctctctcagaagattatcgctctcagagtcttcatcttgccacaacttgacttttacatgttccacaacgtattcagagtcaatgacttgaaagcgacagatcagatgatccgaggcctgatcgacaaagaagcgccgacgtcaaacattccggtttcatttttctacatgccgaagaacaaaggcggctttggactcgttaaattggaacttcgccagcctcagctcgttctcactaaatttgcgaggttatggttaagtcaacaagcagaaaccaaagccttctttcacacaatggctcaagaagagaagtcattccgcaaggtcgtcgaagaccaagaaaatggtttcttaggcatcaagatggaaaacggcaaaattgtccagaagaacgaaagatccaaacgcacaaattgtttcatcacacaggcggctaaagcagcagacaaactggaagtcagattcaaagaatgggacaaaggaggcatacaagtcagaggtgtaggagaaaatgcaacagactggtaccgctcgaaacacatcggccaaatctcacccttaatcggtcgcgtcatccaacagaggcagtacgaggagttcaagaaagacgaaacacactcacacactttctgcgaaccagcagcgctagcggagtcacacgacatcatgaagagaccacaagctgttccaaacaacctctactcagcggctattgctctccgtacaaacacagctccaaccccagcaaacatgcacttccacaacccagaagttttggctaattgtccattgtgcggatgccaatcctgcactctcttccacacattgaacatgtgcagaaaccgtttcagtctatacaaatggcgccacaatatcatatgcgatgacatttaccaattcattcacgatcactatccaggagtaaccatcaaatgctcggcgagaattacaagtgacggctaccaaacaacaggcccagagctcgacgacacagttaaagatctcctcccagaccttgttgtctacgatgaagcgaacaagatgatcaagatcattgaagtcacatgcccttacggcacggacaacaatgttggcaactctcttgacgcggcatacgacaaaaaggttaacaagtataagagccttgctgaacaaacagagagattatttaactggaccacgacgctctcaattatcgtagtctcatcactaggagtcatccctctccgtacaaaactcgacgcattgagaatctcacctgcagatcacatacagctactcaagagactttcgatgcacgcgatagctgcgagtgcttgcattgtttttgaaaaagtgccagaattcttcggtatgcgctgccgtcccctcccaggacgagtcacagctcccaatgcagcgatcccaccaaacaacaatgaaaacaataacgacacagatcatggtcaggagaaccaacaggcaacctctgaagagcaaccaaccaacaatggaaatgctcaagaagacaatggccaaggcgaacaaataaataattcaaccgaacaaactatctctgttgatcaaatcatcgaagaagatgctgagaacaacgcgatagaacaagccttagaccaacccgatgaggacgaattccttaactaagaagagataagacgagtgagaagaacagaagcatagtaggattggcagagcttaagcgatgtcactcggtacgaaacgtgtaccaaacaccggattccgtgctaggaatcacaagccaaaataaaagagacaccacgaaaattactcaccctccctcaaacagataataatattaacctcccatccatcagtccgtatggtctgataacagactagcaccacatccatgatacactcattggagtgaaaaccaccaacaacaaatccacctagaccaaatcctgccccacctccacccaagtagctcgcttcgctcgctcacctaaaactttgctcgctcgcttcgctcgctcgtcttaaccctttccgaataaacacttacaattcccggctcgccccatttttt

SEQ ID NO: 1050 - DNA, 7059 bp, Caenorhabditis brenneri
gactcgccttggggaaggtwtttcaggggksaattgccgmaggcaaggcagcccccsmmtagcttacaaagtaagtacmcattttcatttcttgtgaattctttaaacatatttttcttgttttttgatttcttttttctctaccttcccccaattcttcccctcatcttgtgtatacatccccctcctccaaccaatcaatacattgacctctctcttctgtcaaaaaatcaatactagtatattgtcccttgtatagtattatttgacgtcgtctttgtattaggagtaggtaacaawctgtgtatggcttcaaaaagcatgcacaaacwcctgtcaaaaagtawttcccatcmtgtgaatagctcaacgacwkgaagmccaatgatatgagatatcatmgctccaacmacccagcascccgcacctcagacaatcamtggagatcaatccmaaaggacgtccgtcgcccagatccgtcaactatcgaggagaaaagcaggtataacaggtccataggtattccagattcgctcaaagawcggagcagtgcagtccgcagcakgagcagccmacctccgtcaggtccacaggacgtccgtctcwccaattcgccatctctcgatgataggagaaggttagtwgattgtgaaacaacactagggtcataccgcgaatggacsgataaaccaatgatgggaaagatgacgtatgcggcagtgacaaaaagagcgcccccaagaccgcaaacgggaggagcccggttgagcaccaatctcctagcagatgaaatggagataaagtatcgagacaccaatgacatccgccttgtcatagaccttcccaatccccacctcatcaagtgtccgctctgtaaaagctgcataagtgcgcggggaagaggtgctaatgcgctgaagtacatgaaaaggcacatagccgacgcccaccacctcaacgccgacttcgtctacaaatgtagcaggtgtcaagagcatgaaccagaaaatgtatgcggcgcgaagtggattgtgaatcatctcaaaagagtacatggctatactctagaagatgccgtatccacagcaaaaccctctacaaggcagcagattgcaaacgccttcaacgactctgctccattcatagacgcccggaaaacatccgatgtgccagagaagaagagcagagaggcaggacttgagaagttcctggcccctacaaagtccgaggacacaagggaaaaaaccccgccctccaccagaaagtcctctgaaagttcagaggcatcaatccaatcgaccatccaagagactctttcggagtcgtcagacacattgaccgtccaagaaataatcaatatcagcagtgaagatgaaatggacgaggagccaccgaaacggcgtgtcaatgtctgggccttgatccatgagaatggcaaggacgcctggatagactcagacttgatggtcatattcctggaatcaagagcaagaggatatgaatcatgcagcatcatagaccctctgaacttcatttgcactgacatgtcctatctgaccacaatagtcagaaggcgcatggaagaaggctacaagaaaatcatatttccattatgtgcaaatgaccactggacactggtcacgataacaggtagcacggccaccttttacgatccaatgggaaatgagccaactgagactgtcaagaagatgatcgatgagctcgaccttgaaatgcaattagccccgtcaaactctcctagacagagagactcgtggaactgcggcgttttcgtcatgaaaatggcggaagcgtacatcaaggatacgcaatgggatctcacggacgtagacacggacgtcaaaacgttcagaaggagcctcctaacagagctcaaagcaaagttcaacatctttgccgaggatatccagacctaccggccaccctcaaggaaagccttaacgaggaacagccaatcgcctgtcgttgtttgtcacaagtgctctcggccagccacaccgatccaggatgtgagcagaatggaagtggaagaagcgccagtgctggtaccgactcctgaagagcctccacaggaatggaccttcgtcggaaaaaacagaaagcgtggtgtgacaagccgaaccccgaacacgtcgccggaagccaagcgaccggctttcccaccagtacccctcaaaccatcagccaacagatggcactttccagaagaggaaactgaaaagatggaggtctcaagtgccgacgaggtgaagaactctacccctccaaaaccacccaagatacctaatcttctcgcgatgaaaatcgccagtcccgtacctctgaagagaggaaacccgtcaaagaagcacggtaaaggacacatgatgaatacagcgagaaagggtccgacaaagaaagagatgcccaaaggggaaccagcgaaccttatagttaaaatcagaagctggtttgatgagcaactgaagatgtacaaggatgaagggtccaatctacaaagactcacatggttatcggactctctgaccgccgccatcggaaaagcattcaatggcaacaaatacatagtggaccaaatcatcaagagaaacccaccaccacttgttgaaaagggcgcaatgtcaacacagacaagccgaaagagagacgagttcaagccaagggagagaatggcccaagagcccaatgagccgcttcgtattcaatatgccaagaataggcaaaaaacgttcttcaagatcattgggaaacagtctgaacagtgcaccatcaacattgagactgtcgaacagcacttccgaaaaacactcaaggctcctgtagtctcagagaatgcaattaaaacggtctgcggaagcatcaagaaagtattgatgccaaagaccatagaagacccaatctcctccgtagaagtcaaatccatcttgacgaaagtgaaagacacgtcaccaggaacagatggtgtcaagtatagcaatctacgctggttcgacccagaaggggaacgcctcgccaaactgttcgaagaatgtcgcaagcatagagaaatacccagccattggaaggaggcggagacgatcttattgccaaaggactgttcagatgaagagaagaaaaagccggaaaattggcgtcccatcgccctcatggcaacaatctataagttgtattcagcagtgtggagcagaagaatctccggtgttcaaggggtaattagcccgtgccaaagaggctttcagtccctcgacggatgcaatgagtcgatcggaatattgcgcatgtgtattgacaccgcttccgtactcaataggaatctctcttgctcatggcttgatctcaccaacgccttcgggagcgttcctcacgagctgataaggagatccctagaatcattcggatatccacaatcagttatccaaatcgtgactgacatgtacaagggagcaacgatgaaagtcaaaacggcagatcaaaagacgcaaagcatcaaaatagaagcgggggtgaaacaaggagaccccatttctccaaccctattcaatatttgccttgaaggcatcatcaggatgcatcagatgagagagaaagggtacgattgtgtcgggcataaagttcgctgcctagcgttcgccgacgaccttgcgattctaacgaacaacaaagatgaaatgcaggaagttatcgacaagttggatgcagactgtagaagcgtgtcgttgatctttaaacctaggaagtgtgcatctttgactatcgtgagaggtgcagttgataagtatgcaaagatcagaataaatggagacgcgatcagaacaatggcggatagagacacctatagatatctgggtgtaaagaccggagttggtggaagagcatcggaaacggaagctttaattcaggtggtcaaggagctccaaaaggtccacgaaaccgacctggctccacatcaaaaacttgacatcctgaagacgttcttactgccaagactgcagcatctctacagaaatgccactcctaaactgtcagagttgagagagttcgagaacgttgttatgaaatcagtgaaacggtatcataacataccaataaagggctcgcctgtggaatatgtccaaatccctgtcaagaagggtggactaggagttctatctcctcgactcacatgcctgatcactttccttacctcgaccctctgcaagctatggtccgatgatccattcatatcttctatccacaaagacgcactaagcagaatcacagtgaaagcgatgggactcaccactcaaagtgccacaataaaagagacatgtgagtacttaaacacaaggaaagctgtcacgaaaggaggatatagtctattctgccgcatgaatgaatctctccgcacgctgtctgtcatccaaggtgctccactgaaatcaatggaattcatcccggtgaacaatgaaatcggtatagcggtacaagccacgaaggattccgagatcaaagtcttcacaaaggctgacagcctgaagctaatgagtaagctaaaagatctggtcagatctgctatgctcaaacggttcctcgaagagaagagtgttaaaagcagagtcacccaagtactccaacaccacccacaatccaatagattcgtcagggacggccgaaactgcagcatagcagcwcagagattcgtgcaccckgcccgtctgaacctcctctcctgcaacgccaacacatacgatgttaaccatccaaaaggctgcagaaggtgccaggctgacttcgagtctcagcagcacatcctgcagaactgtcactacagtttggcagggggaataacccagagacatgacagagtcatgaacaggattctgcaggaaattggaaacgggagaaaagctcactacaagataatggtggatatggaaaccggcgccacaagagaaagaccggatatcatcatggaggaaagggacggtccagaagtgttactagccgacgtgacagtgccctacgagaatggggttcaagcggttgagagggcgtgggataagaagatagaaaaatacaagcacttcctagattactaccgcaaaatcggaaagaaggctacgattcttcccctagtagtcggtagcctaggaacctactggcccgacacaagccactcactgaagatgcttggcctttccgacggtcaaataaggaatgttatacctgaaatctgccaaattgcactggaatcctccaaaaatatctattggaagcacattctcggtgatagctacaaaacggtggagggactattttgtcagaggaataacaaagaagtccgattcgaaggaaaaggtgaaaaacaccacgtgtcacaaagattccaacctctgaaatgtgaaaaggtgcgtacaatgaaaagcacaaaagaagagggtagaagtagatcgaatgccaagaaaggtccgaactggcgaagatcaaaaagcgaatcggacggaaggagtgtgagtaaaggcagatactggcgagatccgtcgaacaagccgccacactcgaagatgacccagtcggctttagctaagcgctaaaccggctcctctgggaggaggtatgtcagaggacattctccgtgggcggatgggaggagtagggtaacgacccgtcattctggatgcctaaaccaccacaatctgtcaaggcaaagtgccccaaaagcacacgcgtggatcggtttggatgccgactgagccagagggcaaagtcgaaggccggtaggctcccggcgggttgtccgtcatagtcagtggtgcgcctacacccaactgctatgacacacaaggacaacccaaaataaataagccaaggcggcgttagcttcgagctaacaagctccccgagaggatggttgccacagggcaccatcctggggaacgacccgatctttcggatgcccaaccaccgccaatctgtcaggcaacgtgccccaaaagcacacgtgcggagcggttggatgccgactgagccagagggcaaagtcgtaggccggtaggctcccggcgggttctccgtcgtagtcagtggtgtgcctacacctaactgctatgacaagcgtataggaggcccggaaaaacaagccaaggcggcgttagctgagagctaacaagcttctcgtggatgggtgccagagggcaccatcctggtgggtggatggggggagcttgggaacgtcccgatccttcggatgcccagaccaccgcaatctgtcaaggcaccgtgctccaaaagcacacgcgcgggttggtttggatgccgactgagccagagggcaaagtcgtaggccggtaggctcccggcgggctctccgtcatagtcagtggtgtgccttcacccaactgctatgacatgcgtacaggaggcccggaaaaataagccaaggcggcgttagcatagggctaacaagcttctcgtggatgggtgccagagggcaccatcctggtgggtggatggggggagcttgggaacgtcccgatcgttcggatgcccaaccaccgcaatctgccaggcaacgtgcttcggawggtcattggttctagacttgtaatagaccattggccggaagagcacacgcgcggttggttggatgccgaccgagcctagagggtgcaaacctgaagggcgaggtcgaaggccgtgaggctcccggcgggaaactccgtcatagttagtggtgtgcctacacccgacgactatgacacataggaggaatcctgatctgatatgatcatgtatatagggagggcgaaggtaaatagtcagkgtcaaagtccacgtggcagctactccccagcatagtagtgatgcgagtggawccaactttgacactgatgttccctgagcctgacccatctgcacaaatccaacagtgtatgatggcccacacactgaggacgagtatcacttgtgatactcagaggtgtcccccatgatcaaccaatatcacagctagcggacctaccgtgaggtagacccccgccgctgtagcaggctcgcctc

SEQ ID NO: 1051 - DNA, 6643 bp, Caenorhabditis remanei
ccaactctcatcgtattaacctacggtattcactcctagtgagtgtaataaaggttaattacgttttctcttgcmagagaaaaagaaaattcgaatcctttttgtgtaactcacaaactgacagagacctatcgaatttcctttgtttcgtatataggaatagtcactctggaccacgaagtggacagttgtcggcggacttccagagtggagagaaaaggtgtgaagagaggaggtctagaaacacttcggctgtctaggaccagttcctgagtggaaagaggaaggtctagaaacacttcggctgtctaggaccagttcgtgagatctctcgtggagagttgaaaacagtcagctgaggctactgtatttcttgatagccccgcccccaatccccctcccccccccctcgacagatttttctgtttgacctcctggaatttgcgaggagtgcgcgagaattttcgaattcttcgcgcgttttctcgaaattttccagaagattcgagcggagaatcttcgagaaagtgagctgaatttcgcgcgaattttccgcgattttcaaattatcgatttttgtcggaaaatttattttctggcaaaatttgattgagttcacgcgggagagaaggaattgttggaaaagggtattgatttttgtggcggaggaaactcccactgaatcaataactctcaaaggagaactcatcgaacaacctcgggtgacctgaatcttgggcgaaattttcgcattgacacaagataamacaaattactgtkgaaaataaatcagaacaaactgtcaaaaagagagacaaaaagtattgattaacaacatcatgacaaatgtatatcttaagcctgtgaatgataaccagactaacaaaaccggtgataattctagaaatactatgtcaaatagtcaatgtgaaatgacgtggaaacctgtagccagaacatatgctcaggcagccagtactaacccggccgacgacaaaacggtgactgtccttgggtgcaaatacaatctgctaaaactgggaaatactcctcagacgtcgaaaaggtcgcctccaaaaccatcgagaggaggagctcgaatcagcagtgtgtatactctgactgatgagctggagattacgcacagagaagaaggtaagatcacattcgcgatagaccttccaaacaagaataacatcttgtgcccgctgtgtcgggagtgcacccaaacccgtgggagagggtccagttttaccaagcatatgaaactccacgtgaaagagaagcaccaacttgatgccacgttcatctacaagtgtagtatgtgcaacgagtacgaaccggaaaaaaaatgcggtacgaagtggatccagacccaccttcaaaaagtgcacaactacaagtatgacgagtctgcaatagttgtcccagtaccacccaacacaagacagcaaatagctaatgagttgaacaatgctgccccattcgttgacatcagaaaaccgaaagctgctgctgttgaggagaagaagactgaaaatggtgctctgttaaaattcctgaccaagtccaataaggacgatcaggtaaaatccccatcggawgatattccagatgcggaaagccctgaaaaagaaactcaggcgctcactatcgatccgaaagggaacaactcaccatcaaaaagctcaataagatcgagccagtcctcagcttcctccgtttgtcaagaaatccaggaaatcatcacgttgagtgaggatgaagacccaaaaggggctcgtccaaaaccaggaatcaacgtgtggagcttgataaatgaaacgggaaaggatgcatacattgatacagatatcatgatggcgttcttgaagatgagagtggaaaactgtgactccgtgaacataattgatccactcaattaccagtttcccgcgagagtggacctagtcccacttatccagaggaatctggaagacggaaagaaaagagtcgtgtttccgatctgtgcagacgaacactggacgctcttgaccatctcgaatggaattgctgcattctatgatccgactggatcgcgaatgagtagttatattgaagagttggtgaacgaacttggactgattatcccaaaggaacaggatgaacagccaagacaaagagacagctacaactgtggggtatttgtgatgaaaatggcggaagccttcatccaagataccgaatgggaaatggaggaagtagaggaagacgtgaaaaacttccgaagaaatctccttgaagaactgaaacccaactacgagatatttgctgaaaaaatcaaatattataactctccgggaaaaagtttcgcccaaagtcgacccacaagtcgaagcagccagtgtgccgtctgtccgacgtgctctcgttcagctacaccgatgatggatgtaggaaacatggaagtggatcccgttccacagcaacaagagacaccgaagagtcgcgagccagaacaagatgaaggctggaaagtggtgggaaaggctagaaagaggggagtggtaactgaacgatcgccaaacatctctccagaagccaagagacaattcactggtccagagatcaaagtcgtctcacctgggaagtttcacccacttgtgggcgaaactgaggagatggaggtgacgtgtgacagcccaccaacgaaagagcccactacggaaccgaaagtgactccaagcctgccagcaatgaaaattgctagcccagaagtgacgaaaaagcaaacgtcaaagaagaagggaaagtatggcaaaaagaaacagsagacaaagaaagctcagccgccgaaaggggagccaacaaagaaagctcagccaaaaggagaaccggcaaagctcattgagcaagtgagaacttggtttgataaacagatgaaatcgtaccaagagcaaggttctaacatccagacactgacctggattgccgactcactcactgccgccatcttcaaggcaaacagtggaaacaagtatctggtagataagataactgcaagatgcccaccaccattgctgaatgaaggtgagatggcgacgcagacgagcagaaggacagaagcggtgaaaccaaaagatcgatttgtaaaagaatctaacgagccgctcagaatccagtatgcaaagaaccgagcaaagaccttcaatgtgataattgggaaacactccgcacgatgtgaaattgatattaacgtcgtggaaaaccacttcaggcaaaccctgaaagcacaaccagtaacagaagaagcattgaatactgtgtgcagtggaatcaaaaaggcgaaagttgatccaagcattgaaggtccgatctcgtcaggagaagtgaaagcgattcttgcaaagatcaaagatacctctcccggaactgatggagtgaagtacagtgatctgaaatggttcgatccggaaggtgaacgtttggcgttgttgttcgatgaatgtcgacagcacgggaagattccgagccactggaaagaagcagaaactgttctgctaccaaaagattgcactgaagaggaaagaaagaagccagagaattggagacccatctctctaatggctactgtatacaaactctactcctcagtctggaacaggagaatctcctcagtkaaaggagtcatcagtgattgccaaagaggcttccaggcgatcgatggatgcaatgagtcaatcggaattctgcggatgtgcatagacacagccacagttctcaaccgaaacctgtcgtgttcatggttagacttgacgaacgcttttggaagcgtgccccacgagttgatcagaagatcactagccgcattcgggtatcctgaatcagtcatcaatataatcagtgacatgtataatggatcgtcaatgagagtcaagacagcggagcagaaaactcagaacatcatgattgaagctggagttaagcaaggtgatcccatctcgccaactctattcaacatctgtcttgaaggcataatccgaaggcatcagacgaggaagacaggttacaactgcgttggaaacgacgtacgttgcctggcatttgctgacgatcttgctatccttaccaacaaccaggatgagatgcaagatgtgctcaatcagctggacaaggactgtcgtagtgttgccctgatatttaagccaaagaagtgtgcttcactgacgatcaaaaaaggaagtgttgatcagtatgcaagaatcaagattcatggaatgcccattcggactatgtcggatggggatacctacaagtatctcggagtccaaaccggaaacggtggtagagcctcggaatcagaatccctgactcagattgccgcggaactccaaatggtccatgacacagacctggcgccgaaccagaaacttgatgtgctgaaggcattcatcctgccgagactgcaacatatgtacagaaacgccactccaaagctgacggagttaaaggagtttgagaacacagtcatgaaaagtgtgaagatgtatcacaacatcccgattaaaggatcaccactcgaatatgtccaaattccagtaaagaatggaggactcggagttatgtctccccgattcacgtgtctcataacgttcctggcgtccacactgttcaaactgtggtcagacgacgaatacatctcgtccatccacaaaaaggcgttgagtagaatcacggcaaaggtgatgggactgaagacccaaaaagccacgctccaagagcagtgcgagtacctgaacaccaagaaagcaatcacgaaaggaggttacagcctcttctcgcgaatgaacgaagctattcgaacgctcagtgtcaaccttggagcaccgctcaaatcaatgcaattcattccggaaaatggcgaaattgctttagaagtgcaagcatcagaaaactcacagatcaaagtattctcgaaagctgacagtatgaaactggtgacaaagctgaaagatctggtgaaatcggcgatgctcaagaacttcttggaaaacaagaaggtcaaaagcaaggttgtgcaggtgcttcaacaccacccacaatcaaacaaattcgtcaatgatggaaagaacwkcagcatwtcctcccaaaagttcgtacacccagcacggctgagccagctggtctgcaacgggaacagctacagtaaagaccttccgaaaaactgcagatggtgcggctacgaatgcgagtctcaggctcacatcctccagcattgcacatacagcctttcatctggaatcacccagaggcatgaccgtgtcctgaacaggatcttgcasgaggtgataaaaggcagaaaaaacaacgactactatgacataatggtggatacggagcccggaccaaccagagagcgtccagatatcatcatgatacagaaagatggtccggaagtcctactggcggatgttacggtaccatacgagaatggagttgttgcgatcgaagccgcgtgggattggaagatggagaagtacagtcactttattgattacttcgcaagactgggaaagagagcagtaatccttccactagtggttggaagtcttgggacctactggccagacacctcaaactctctgagaatgctgggtctctctgatgggcaaatcagaaacctgatcccagacatctccatgattgctctagagtcttccaaacaaatctactggaggcatatcttcggagatagctacagaattgtgagtgatctatactgcagaaaagaccagcaggagatcagattcggagatgaacccatggaaaatgttcaagtctcagatcgattccagccttttaaaacaagagagcgtgagaagaaatccgaggaagagaaaaagagaagatcaaagtccaaaaaaggcaaaacttggcgaggatccaaaaaacaaactgattcccggcaatccggcaaaagcaatcagaatcagggcttccaaagaagcgttggacaaggcgtatcacggtgaataccgtcagataagcccccaacataaaaataaaagtcggcgttagctaaccactaaaccggctcctcattgggggagagtatcattccggtgctctccgtttgggcggtagggaggagttgggtagcgacccggaagtatggatgcccaaccaccgcaatctgatctggcattgtgtttcggatggtctctgtctctagatctgaaatagagctctggcctgaagaacacacgcgcggaccggttggatgccgactcgatctggagggtgcaaacctgaaagggaaagttgaaggccgtgaggctcctggcgggaaactccgtcatagtcagtggtgtgccaacacccgacgactatgacatagttggaggaatcctgatctgataataatcattgttcatataagggagggggatggtaaatacccagggtccgaaaccatcaaagcagctactgaccagcatagtagtgatgaacacatagaccctggggttccctgaactcgacccatctgcacaaacccactttgtacaaatgaaccaaactgatgaagagtttaatgatttcttacatcacagctagcggacctaccgtgaggtagactcccgccgctgtagcaggctcgccattg

SEQ ID NO: 1052 - DNA, 7796 bp, Caenorhabditis remanei
cccttttctatcgtattaactacgataaccgctcatttgagtgtaaaaaaggttcccccctcctcgcctgccttacccacgcatctctgcctctgggaaggcggagggtcaacttgcgggtctgtggatttcctttcctatccaccgcccatattctctgtcgaaagcctacctagatcagccgggagtttttcctatcccattcaggcgatcgctcaaggctgttttatcgacactccttcttgacaagtatttatttcttgacaaattctatttttccttttatcgattttctcttatttatcgattcttgtgaaaatatgaccaagaccgaatggtcctggcgtcatcgatctcgctcccgctctgttggaatcgttgtgaaaatcgatacaagcgactatgctaacgtccgagtgcatgtcgcggcggacctttccaatgaggatggccacacgagccacaacaacggcatcattctccccatcccaatgaagcccagcgtcgatcgattctgtcaaattcaataccctccaagagggtactatgttccgcatcctcaaagtcagaaaggccatgatgcaaagccctcgcgtcattggaatgaagaggcacaacctccctactaccacaacaacaatcatgggagaagggggcgttcggcaaaaccaagtggacgccgacccccacgaaagcccatacttcaggaagagtccctggcagcgcacccccaaatacccggggatactgcgtcagcggtcccactgtactccgacgtcgtcaacaatgaaaacaagagtcaggggaaaccaccgcaagggtcccacagaagaagtggaagaccaggaacaaagccctctgttccggttggtgaggcagagcaagaaacgaattcccgtccaattgctccagaacccatcgtgaaattcaaacacgataaacacgggtggactactgtccaagggtcccacagtagtggaaggccggtaccaaagccctcggtaccggtggtttcagaggcaaatcggttccagttactccaggaaggggattttccaccccttacaacatccgaatcttcgcaagaagagattaaagtaccgaactaccaacgaatagtgtcaccgattcctctcccctctgaagaggatagtaagttgccgactaaatcaaattacagagcgcccaagggacgaaagagtcgcaactacaagaagccacaacaacaaaatccgaagaaatatcagcagaggttaccctatcaacccaaggtcaacaatgctccgacggatcgcatggccccagaacaactcaaaggaggaggaggaaaaaccgcccacaatgacattgaagagatggaaattgaggaagacactgacgagaagattatccaagtgaaacgaatcaaaatcgtcaataagctaactccgcatcactttgtttgcatgatgacgtatccaaccgacaacatctatagatgcttcgtcaaaggttgcacagcaacatcacaaggtggttggggagcagaggaccttaagtacctgactgtccatatcagacaagaacacaaaattaaggtcgaatggacgtacgaatgcgggatatgcggtgacctatcgggaggtgctggcaaacatatcagtaaatggatcaaaccccatatgaggaagaaacacaatagagatgccccaaccaatttcaagatgggttcaagaagttcaggtaaacccaagattactgaactactggaggagagcgccccgtcttgctcgaatccaagaaggaaaaccctcaaccagaagaagactgctataatcacgcaagtcactccggagaaattgaaaacgggctatcaaacgagaagtgtcacgaaggctctcagcgtcctgaaagagtcacgacaaaaagagctggaagtgttgagagaagaagaaaaggctaacgctaaacaaaagtctaaacttcatcctttcttcaccaaagcccctcatatagatggtgtgaaaccaacagtacggagagaactatcaaaaatgattactcccggaggagaacataagggaacaaagataccaatggtccacaccaagcgcggtctcatccaaaagataaacagaaaagctaaaaaggctaaaccaatgcatcttgacgaaagtaccatcatagaagcgtcacagctcgacgtcatcactattgacgacgacgacgaagacgacaacatgacaccaatgcgaagaagattcaacacttggtgtcttgaccacgagacgactcaagaagcatggttaactgacgacgtaatcaattggtacttgaaagacctatgctttggtaacgaacaatacatgctcgtagacccactagtatggctgatatacaagatgggaggaatggcaggcgtcgaacaaaggttcaaaagcaagaagacgtgcctattcccaatctgcgaagctgaccactggattcttcttgtattcgatgagaccaacttgtgctacgcgaatagtcttggatcccaaccaaacggacaagttaagaacttcattcaacaactcaaccgaaagctctgcagctttgagaaagaagttccacttcagaaagatagtgtaaactgcggagtacatgtctgcctgatagcaaagtcaatagtcaatggacaattttggtacgatgattcagacgttcgaacgtttagaaccaacgccaaggcggctctgaaagcccagggctacgagctcttctcggaagcaccaaaacaaatcgaaaacccagactccagccacagagaagacatcaaggagaacagtatggaaatgtgttcggaatctttgatgatcgttgcgactccacagaggagtgaagcacctatggaactagtcgacactgagcctagtgatctggaatcgccaaagtcagacagagtagtctacgaagactgcatcacagctctatctgatgtttcggagccaagaatgactccagaaaagagcgaaactccagaggtgccagtggtggaagaaagagatctggattggccaaaactggaatcgccaaagtcagacagagtagtctatgaagactgcatcacagatctgtctgatgtttcggagcaaagaatgactccagaaaagtgcgaaaccccagaagcgccattggttgtagaatgtgttgagttggaaaggctacctaaggatctgccagtcacagacaggtcaactgtcgtggcaatccctgaagcagtaaaactggaggaaaagtcagaagtggtaattccacggctcatggagttatcatacaccgtccctccagaaccctctccagtggttgaatacacccaaccatacactcacactcacactaaaccaaaggtcaaagctacatgccagatgggaaagaaaaggaaggtaccaactgggaaaccagacgaactgattcagattgtgagacaatggtttgagaaagaattcaacgattatgttacggaaggacgaaactttcaacgactggaatggcttacgaacttactcaccgccgcaatacagaaggcatcagctggtgatgaggaaacaatcgaaaagattcgaaagagatgcccacctccagaagttagagaaaacgaaatgtccactcagacatctcaacgtcaaaagcctaccacaacgaatcagaagaaacgctctagaaacactactcaatcggatacacaagccaacacatactggcgaaatcgagccaagacatataatcaaatcataggtcaagatttcaaacagtgtgacataccgatcgcgatactagaagaattctataaaaagactacctcagtgaccaatgtccctcaggaaacccttgtgaaagtcacctcaagactaccaaggttagacattggaaagtggatcgaggatccgttcacggaacaagaggtatttggtgccctcaaaaagacaaaagacactgcgccaggaacagatgggctcagatactatcacctccaatggtttgatcccgactgtaaaatgttgagtagcatttacaatgaatgccagcaccatctgaaaattcctgcccaatggaaagaagctgaaacaattctcctcttcaaaagtggcgacgaatccaaaccagacaactggcggcctataagtctcatgcccaccatctacaagctatactcaagtctctggaataggagaatacggacggtgaaggggattatgagcaagtgccaacgaggattccaagagagagaaggttgcaatgagagtatcggaatactgcggagtgctattgatgtggctaaagggaaaagatcccacctgtccgttgcatggctggacctcaccaatgccttcggttcagtacctcacgagctgattgaaagcacgttaagtgcatacggctttccggagatggttgtacacattgtcaaggacatgtataaagacgcttccataagagtcaagaatagaacggagaaaagtgagcagattatgataaaatctggggtaaaacaaggcgaccctatctcaccaacactattcaacatgtgcctcgaaacggtgattagacgacatctgaaagaatcatcaggtcacaaatgcattgacaccagaatcaagcttcttgcatttgcagatgatatggccgttctagcagaatcaaaagagcagctacaaaaggagcttacagaaatggatgaagactgtacacctctcaacctaattttcaagccggcgaagtgtgcaagtctcatcatagagttcgggaaagtgaggacccatgagcagatcatgttgaagcgagagccgatccgaaacctcaatgatgacggaacatacaagtatctgggagtgcatacgggagcagatgcaaggacatcagaagaggagctgatcatttctgtaacaaaagaggtagaccttgtcaatcgctcggcgcttacgccaccccagaaactggactgtcttaagacgttcacactcccaaagatgacctacatgtatgccaacgccataccaaaacttaccgaactttcagcgttcgctaacatggtcatgcgaggagtcaagataatccactatatcccagttagaggatctcctcttgaatatattcaaattccgaccggcaaaggaggacttggagttccatgccctagaatcacggcattgattaccttccttgtctcaaccatgaagaaactgtggtctgatgatgaatacattcgtaagctctacaactcttatctgaagaaggttgtggaggcggaaacgggaatagtggaggtctccacaaaggatctagcagagtacctcagcaacaaggtaccatccagaaagcacgaattcgggtataactgctactcgaggattcgcgaagtttgtaatgggctagctctcaaccaagctgcccctctctacaaacttgaattcatcgaacaagacaatgagttagcagttgttgtccagccgactgaggagagcaaggaaaggattttcactaaagatcatgtgaaaaagctccagtcgctactgaaagccagcgtgaatgacgcactgctacacagattcttgacaacaaaacccgtcaaaagtgaagtggtacaagttctccagcagcaccctcaaagcaacagcttcgtccgaatgggaggtaaagtaagtatatcggtacatgtatggatccacaggtcacggttaaaccaactaacgtgcaattataacatctttgatccaaagcaaccgaaaaactgccggaggtgtggttataagaacgagactcaatggcacatcctgcaagactgcacatatggctgggctaaacttatacgagaaagacacgatgccgtacatcacaaggtagtcacaatgatttgcgctggggcaaagaagaactggggccggaaaatcgaccaagaactgcccggtttcacttcactccgtccagacatttgtctgacgagtccggatggcaaagaggttatctttgcggatgtttgtgtcccttactcaaggacaaggaacatcgaattcgcgtggaaagagaaaatccgaaagtatacagaaggatacagtcatcttgttgcacaaggaatcaaagtgacagtccttccgatagccataggatcactcggaacttggtggacgccaaccaacgaaagtctctatcaactgggtatcagcaagagcgatattcgcagtgccattccattactatgctctactgtgatggagtatagtaagaacgcctactggaatcacatatacggaaactcatatacctcggtcccactgagatacggacaccagaagcccgatggagacgattggaagaaagaactgagttgcgaaccagttctagctctccaacaataacatgccttggaaggcaccacgccaaaagtcctggcaactgatttgaataatgtataaaagtaactggaaccaaatgcccgataggtagggcgggagaaaatgacctagaaaacacaaagtcccaagcccccggattcgaaagacctataggaagtcagtgaatagagagaaatatcaaacaaatctcacccattcacaaggacttactggtcgagtagaaaacaagccaaaacatcaagcacgacgcaaaaaggggtaactttgggcaactaattaacggatacctccgtgtatcaggcaaagccgccaccaacagcaaattactgcccgataggtagggcgtgagaaaatgacctacaacctccaagacccgagcccacggaatcgaaagacctataggaagtcagtgaattgatggaaatacaaaaccaaatttcttccattcacaaggacttactggtcgagtagagcacaagccaaaatatcaagtatgacgcaaaaatgggtaaccttgggcatccaatcaacggatacctctgcgtatcaggcaaagtcgccaccaaactgtactactccgaaaaaaccaagaaacatgattttcccactccgttaaagcatctcaaccaagctaaagcggtaaggttatcatgtcaaaaggtgtagctacagcaacctaaagcccgaaaggtagggccgtataaaaagacctacaccctccaagacctaaacccacgaactcgaacgacctacaggaagtccgtgaatggagagaaatatctcaccaaatctcttccattcacaaaggctaactggtcaagtagagcacaagctaagcctccaagcacgaagtgatatgggtaatttaggcaaccaatcaacggatacctccgtgtatcaggcaaagtcgccacaaacactgtactactccgttactcccaaacacatggatctccttctctcaccaaaaagctttataaccaagctaacggtggaaaggacatcatgtcacgaggagtagctacagtaacctctctcttgagactgcaaagtcgaggatggattgggaaggccgcgaggcaaaaggcgggtaactcggccagacgctagtgatcttcggatccgacagccctggccttagaggaaccctgggataaggagcacgacgggaaggatgttccgcaaggatttcccttcccattagtcagggctggcagttggtaatatagcctttctacacaccaccgtcttgcacccactaaaccagtgggatatgcgggtggactcaatgtagaaaggtgttcccactgcctgactcgccaactttatatgtcttgtcaacataatggcccctcactataaactccctagcaactggtggtccggcgaagccggttcttgccactattgcgccccaggctcgcc

SEQ ID NO: 1053 - DNA, 5821 bp, Schmidtea mediterranea
ttaaatcatttttaaatgtgtttgaatatcttaaattatcaaatcatattaatatcaatgctaaaaaaaaatcgtgckcatcaggcgcacgaaaataatggacacaactcgtcgacctgctgtcgactcacagagaacctcaatttggaagaatgggaagcctataatgctacaattccgccaacccctatttgaatgacagatagtcaaatatcaaaaaatatacaaactgctgtcaagcgtgactcacttccttccaatcgaaaaataggaakatgtaagaaacatgaaagtcaagctgaaaaaccaataatatgtcctaaaataaaacaatttgaaaatatgcaaaaaatacctataaaatcacagccgaataaattcccatccgttctaagcagaaaccgctacgaactactgcaagaatcggatcaagtatattaatttccccccmgggggaaattaatatacttgttakaaaattaattttttaataaaaataaataaatcgaataaatataaaataaaaataaatcaaattaaacttttattaacaataaaatcgcagtaagtaaatttccactgttattaaatttaaaacaaaattcctttaaaaatgcctctctttttcagtaataacaccttttcttgcttttattactatttcttgtgtactgtacaaatcgagcacagttattgcaaataggacatagaaattcctttttaagtaaatttaaatccatgagaaataaaataaaatccttttgattcaaagtttctatgttgctttctaatagaatggtgtaagcattaatgggtcttgatttttataaattaaatatatttaatctattaaattaatatgtttttattaattattaatttttatagtggggggaaattaatatacttgatcccaagaatcaactgatgatgaagaatatgttatttcaaaatacatacaagaagctggaaaaaacaaatcaatcgctacaatgaatgtggatctcgatgcaacaattaaaagtattggaatgaacacaaaagagacgacctatccaaattcacaactgcgagttgagacgactccctgtacctcaacgactattatgcatgcatcttgcaacacaaccagcactatatcttactctccattaccatcggctgtgtcacttcccgaaagccctgcctcgtcaatcacaataaccacaacagacgataattgcgatattatagagaccccttacccattacctcaaacaaatggtgacttgagtgaaatattaaaggatatagaagctaataaggacaccaccatgtcgaataaagtattggactgtgactctgacagcggcgatgatcgggacatgataatagaaaatgaccgagaatctgacatggacctgttttcgcaatctttattgaacactaatcaatctgatgagaggagggagaaaaacttaacagaaaatgctccaacagagattactactgagaagagctactttgatatcatcagtaaagcatctgataatacaacctctaagaaactgcttaatgtaaaaaacgaattgactgctggactacctcctatgcctccagtgaccaatactgcaaaattcattcgaaatgttcgacctgaggatattgcagatcctaccctatatcgacttgacagcaggggaaagcttggatgcagaacwcaatacaaaaaacccggatgcggggacatagcagtatatgactatgaggcgatagttgaacatgccgcatttatccacacaatcccatttaatgaacaaaataatgtggattgtcaaccatgccaccctaaaaaaggaaaagatgtccatacaatagttctgataaaatatgcagatatctttaaccatattgaagcccatagccacgttgtgcaaaccgcgattacagataacatgaaaacctatctacgtttaacaaaggaaaatttkttctactgctcatatcgtaacaacaaaaaaaagaataaatgcaaaaaggcttttaaccttgaatcaaacatgatggacataacagagcacatgaaaactcataccggatacagtttcgacmaaaacttaaacattctatgctattgtggtatctggaagccgttcacagagctcattgcccacatcaagactgagcatttgcaagaatatattaactcaataccaaacaaagaaaatatccataatactactaccatagtttcccctctaaactttgctgggatacttgcatctggcgaaactcaaaatatccccgatgaagaaataattaaacccagagatctgccagaaaatcttgccttcaaccgaaacatcgaaaatgaattaagttgatggtcgcagcacttggtcaaagcatatatcttctcttatgctgttaaaacatcaaccatcttcatcaatccttatacttgcaatgctttgatccagtgcaactacaaaactttctttgaaaccttccctttcaaagactttgccaagtggaacgagatagtcctgccaattcacaacaacacttcttcttggtccttcttcttcttgaacaagaaaaaacgagttgcgatgattatcgatccaactgcagatgacagtcataccctgcactttgaattggctacagatatcctaaggactatacttaacgtccagaatatatttgaggacttaaatttccctcttactgaggtcgaataccccgtgtgtcatgaggcaaacctttccgcattttmtgtatgccactttcttaaatgtttaatgtcggacttgccaattgatattccggatatcgatcacatgaaagagacwatgagaccaattattagaaaatataactgcgcaaagtttccggagagtgatgttaggaattaccgcgtacttatcgaggacctgatataccaattgaaccttgacacaattacttgtgaggaaatactgtgcgaaatcgaaagaataaatggaaggttaaatcccaaaagatattttaaagagagtaaaccaaagacggatataatacatctgcaaaagaaaaagtcggcggaactcctctgtgttaaaagattgaaattccaaatcagtcagaaaacagaaatcggaaagatatgggaaaacgacgatgtggatcacagaccgcctatggccagattcttgaagactttcgcgagtcaagactgccccgtttcgaatacgtcatccataaacctaccttactacatggatactgatacagatamgtgtactgattgtgaaaatttgtcgcacatcatgaagaacttggatagctcggcacctggaatggacctcattacaggtggagactggaaaaagatctccccgaagcatgaactgataacagcaatctgcaattgtatactacgaaataaggtctgcccagagaaatggaagctgtttagaacagttttaatcctaaaaccaggaaaaatgtccgagagtttcagagctaactcatggagacctcttgcaatcatggacacagcctatagaatctttacgactctgctgaataaccgcctgctgcaatggatcaggaatggcaacctcataagcccgaaccaaaaagcgattggtataccggatggatgtgctgagcataatgctactctacacttcgcaattgaccgagctaaacgatgtaaaactgaactacacattgtttggctcgatatcgccgatkcatttggttcgctgcctcatgacctgatctggtatacactggctaatatgggtctgaagaatgaaacactaaccttgattaaggaactatataaggatgtgaagactatcttcgactgtcagggaaccttgtccgaacctgtcccaattactaaaggagttaaacaaggttgcccattatcaatgacactcttctgcctgtctattgactacattctaaagtcaatactgactaattatcccttccttcttcatgatctgaacatcagtattttggcatatgctgatgacttggttcttctttctgactcttatctagaaatcaaaaaatctttagagagtactgtggaattggcagcmtttgccaaccttaagtttaaaccttcgaagtctggatacttgtccatcaacaatgttaactccgatatccttaaattacatctctataatgaggagataccaacgatatccgagaataacaaatacagatatcttggagttgacttctcttacaaaagaaatcaggatgttgatggacgacttgggtctgcacttgcactcaccagatctctatttaaatcatacttgcatccggcgcaaaagctgaatgcttacaaaaccttcatccactccaagcttatcttctccttgcgtaattgcgtgataggtcatagaatcctcgactgtgatcggaatagagttacacaaggtcgggaaaaacagctgggctttgatcaggaaatcaaggcactwctgaaaaccatgattggagacaaatttcaggcaktaaataactactttccttacactcactgcaagctggggggacttggtataacctcagctattgatgaatatttgatccaaagcattaccggaataacaagattatttcactcatccaacctcagcttcagaaaaatgctaatcacagaactcgctcattctagaggagggaaaaactttgaagcggggctaaaatggcttaactgtgaagttaacaaggcattccccaacacctctttctttgtaaaattccaaaaatcggcacttgctcttaaaagaaagttctgtatatgcgttaaccttaaatttgtagaggacaatttctcacttgagatgacctacaaaaagcgcacttcttatgtaaaccatcaaaacctcagcacactttccaaagaactccacgacttcgtgggcctttactatgcwgagcaatgwtgtcaaatgagagtacaaggacacattgcgactgcgatcggggatagcataacagctaaatacctaatagctagtgacatccttaacgacgcacagtactacttcttggtacgtgcgagaaataatcttctgaatcttaactacaatgcgtatcgactcaagtataatattggcacaaagtgcagactttgccaccttgatgaagaaactcaggcccatstgttcaatcactgccgtgccaaaccaaacgctagaagagtgaaacacgaaaatgtgctagtaagcatagttgccttcctagagaaaattggatttgagattgatgtggaaaaatcacccaaatatatctcaataccaacaaagctgaaacctgacatggtaattaggtctaagaggaataaagatatacatgtcctagacctaaaagtgccatatgactcaggagaaggctttgaaaaagcgcgggaagacaactatgttaaatacaaagatctagccattgaaattggaaaggcatttaatcaaaaagcgactatatctgctgtggtgattggatgcctgggcacatgggacaagaagaacaatgccgctctttccaaaatcgggttgactaagaccgagatcatatctcttgccaggatagcatgcccaaatgcggtaatcgcatgctatcacatataccgtgagcacgtctcatttacaaagagtgccatggccctccccttcagccttgcatgagtgtgctacgaggcagcgctggtaattgcatcggcgttgcagatttgtgtacgatagataaaaaccaatagtaataaatgctgagcctagctcgcatatctaagccgaaaggcagcatatatatgagacaatttaaaaaaaaa

SEQ ID NO: 1054 - DNA, 4814 bp, Girardia tigrina; identical to SEQ ID NO: 130

SEQ ID NO: 1055 - DNA, 5154 bp, Chrysemys picta
  modified_base (576)..(576): a, c, t, g, unknown or other
  modified_base (1267)..(1267): a, c, t, g, unknown or other
gtttaattccttctgatggacatctgcaacacccgtcctgaagatggagtctcctgcwkccatttttgaaaaaattgatgctgccttgmagatatactccgctgctgctgmtttggawgamaattctctctctctctcacctwcagmtgcastcwcgtcamctsctgctgctcctgcgtcctctactccccagaaaactcagwggaagcctatcccgaakaccactcttggtgcctcacggaagamcmggaccaccascaaggatgaaaamatcagsasctggckgaagaaagcccctgtggatacctctkcagggagamctagcaccagaaggacagctcttcgggacctcacatccaggagcagkaatatcwcamcagctcttcaggaggaggacccccggagaacccctcccwcttcccgggaccaggatgctgagcgccgccctgctgctcctgagaaggctgctaccagaggagcccccccgacgatccaggaccaggatgctgatcgctgccctgctgggagggatgccaccggaggagccccccgacgacccaggaccaggatgctgancgctgccccgctgggaaggatgccgccggaggagccccccccgacgacccgggaccaggatgctgaccgccgccccgctgctccagagagggatgctccmgaaggaaccacctcctcaaccccggaccccgaaaccacttaccacccgcctgtccggaggagggccgctccaaggggaacgcactccgsagcccwggatctcgatgccgcacgctgtccttccgggcaaagagacatcgtggccagtgagtccagcacccccccaggagcgacttcacctcctcaagcttctctgccagaccsagaggaatcacctgccgagtckgcaggcacaacagaggtccgccccacagagggtgaggcaggggaagacgactgcatctacctccagtacccgmtccctacaggcctcctcctctgccccttctgcctccccktccatggagtccagaccctcggggccctcagcaaacacgttcgkaaggcccacaacaaacggattgccttccggtgtagccgctgcgatgcaccmttcgagactcaaaagaaatgcaagtmccatcamgccacatgcaagggacccctcacaaccgcgaaggtsaaccccactgacaccctgcgggttccaaccccgacccccaccgacggtccagcttcagcaccccagccagcatccccagagccacagcangtaaggggggaccaaccgccaaccgagggaagcgcaacccccgcctcgaggactgacgatgccaccaaaaggaccagccccgcctccagaatccccacgctggaccctgccgtgagggggatcaccgccacctcscaggtcagcgacctcaccagatgcctcagcgacctcataaaaaccatccggcacaacacggatacgagacggkgcagcgctcccccacaggtmacctcatgccgccctgccgtaggagcaactagcactgccccccaggccgcacggcgagacccagccaacggaggagcctcccgcagcccccagatcccacggccggaccccgcccccgggagacccaacacctcctccaaggttacccaacgagactccgaccgccaaaaaccccatgccccaccgaggaccccccagccggataccacccgcagaagaaccagaaccatccccagcgcttccaaacacgaccgcgcccccacaaagcccaacaccggtgtttccagaaccccactccctcccggaagatccagcgctgcctcggagacaccgagagctgccccccccccaccgcaccaggacccccgcctcaagacccacctgaacaccgctccccagtccgagggacaacaaggccacagactgtctccgcagcacctgaacccgcggagacaacgcagcaggaggaacgacggccgcgagcagagggtcgccacgccgtggcaatccgcctggatggaggagctggcaaaggctgaggacttcgagaccttcgacaccctgatggacagactgaccgcagaactgtctgcggaaattacagccagaaggagggaaccccaggaggcctcacgggccacgcgcagattccccgcgccgacccgtaacaacactgccagagaaggcaggagaggggacgtcggccgccgctacgatccggcagctgcatcccgtattcagaaactatacaggacgaaccggacgaaagccatgagggagatcctcgacgggacctcctcctactgtgccatccagcccgagagactctactcctacttcaaggatgtgttcgaccacgaggcccagaccaacttgcaacgcccagagtgccttctcccgctaccccggatcaacctcacggaggacctggagcgagatttttccccgcaggaggtgcaggcgaggctgatgaggaccaaaaacactgcccctggaaaagatggcatccgctaccacctgctgaagaagcgagaccccggctgcctggtgcttgctgccatcttcaccaaatgcaagcagtttcatcgcgttccccgctcctggaaaaagtccatgaccgtgctcatccacaaaaaaggcgagcgagacgaccccggcaactggaggcccatctccctctgctccaccatctacaagctgtatgccagctgcctcgcggcaaggatcacggactggtcagtgtgcgggggcgccgtcagctcagtacagaagggtttcatgtcctgcgagggatgctacgagcacaacttcctccttcagacggccatccaggaagccaggaggtccaagaggcagtgcgccgtagcatggcttgacctgaccaacgccttcgggtccataccccaccatcacatctttgccaccctgggagagttcgggatgccagaaaccttcatccagatcctccgggacctctacaaggactgcaccaccaccatccgcgccacggacggagagacggacgccatccccatccgccgcggcgtgaaacaaggatgccccctcagccccatcatcttcaacctggccatggaaccgctcatccgagccatctccagcggcccgaccggcttcgacctgcacggcaagaaaatcagcattctggcctacgcggacgatctggccctggtcgccgacagctcggaaagcctccagcaaatgctcgacgtcaccagccaagccgccgagtggatgggcctccgcttcaaccccaaaaagtgtgcctccctccacgtcgacggtggcgccagggcgctggtccggccatcacgattcctgatccagggcgagcccatggcctccctcgaagagggagaggtataccaacacctcggcacacccacaggagtccgcgtccgacagacccccgaagacaccatcgcggagatcctgcgagacgcggcccaaatcgactcctccctgctcgccccctggcaaaagatcaacgccctcaataccttcctgatcccccgcatctcctttgtcctcaggggatcggccgtagccaaggtgcccctgaacaaggccgacagcaccatcaggcagctggtgaagaagtggctctaccttccccagagggccagcacggacatcatctacatttcccacaggcagggcggcgccaacgtacctcggatgggtgacctgtgcgacgtggcggtgatgacccacgccttccgcctcctgacgtgcccggacccgacggtgaggagcatcgcgcaggaagccgtacgggacgtggtcaggaaacgcatcgccagggccccctccgagcaggacatcgccacttacctcagcggctccctggaggctgagttcgggagagaggggggagacctgtcctctctctggtcccgcgcccgcaacgcctcgagacgcctgggtaagaggatcggctgctgctggaagtggtgcgaggagcgccgggagctgggaatactggtgccacgcataaagaccccggaccacaccatcgtcaccccgaccgccagagctatgctggaaaggaccctgaaagacgccatccgctgccactatgccgagaacctcaagcggaagccggaccagggcaaggtgttcgaggtgtccagcaagtgggacgccagcaaccacttcctccccgggggcagcttcaccaggttcgccgactggcggttcgtccacagggcccgactcaactgcgttcccctcaacggagccatccgccacggcaaccgggacaagcgctgcaggaagtgcggctacgcaaacgagaccctgccccacgtcctgtgtggatgcaaacagcactccggagcctggcggcaccgccacaacgccatccagaaccggctggtgaaagccatcccgccgtccctggggaagatcaccctcgactccgccatccccgggacagacagcagactgcgacccgacatcgtcgtgacggacgcagaaaagaagaaggtcctcatggtagacgtcacggtgccttttgaaaacaggtcaccggccttccacgaggcccgagcacggaaggcgttgaagtacaccccgctggccgagaccctgagagcccagggctacgaggtccagatacacgccctgatcgtgggagccctgggctcgtgggacccccacaacgagccggttctgagagcgtgcggagtcggtcgacgctacgcccggctcatgagacagctcatggtgtccgacaccatcaggtggtccagagacatttatacggaacacatcacaggacaccgtcaataccacactgagtaaccgagaccgccgaccagggaaataacccacttccttccctgacgaaccaagggacgcaccccacccatgtacttattcgctacaccgatactgacttggactccttatacattccatgggtggcgtacccgagcccacttatccactgacactttaaaaactcttgcaccccaatctgggtctatgccggttatgcgatatgtatgtatctcttcatccttgcaaccgatacctgtaatccctcataacccaagcctgaccccagatgtacagtaccttccctcttaactcgtgtatatttaattttaaacattaactttaataaaatttttaaa

SEQ ID NO: 1056 - DNA, 4287 bp, Acanthamoeba castellanii
cccgtcaagggtgctccacgagatccctgtcgctagccgaccggttttaccaccccaccccgcccggacaaccacggaccctgctccgcagcaggaccccacgcacgatggccgctaaatccgtcgcctgccctcacgatggatgcgccaacaagtacgcgtcggaagcctccctccgaagacacattaagaacaaacacgctacagatgaggaaggagatgagacctcacactcctgtccccactgccaccgacctttctccaccgcccgcgggctcagcgtccacattggcaaatcgcaccgtcaggccccccctgagccgacgcgcccccccccggccccggcccctgccgatcccggcctcgatcccgaccccggccccaccgtgacgccccccagccgtgatgacgaagaccgcgaggaacccgacgacgaccccgtggagatcgcggacctaagctgccctcactgcgcccaggccctcccgtcggcccacggcctcgccaaccaccttcgcgcctgcaaggaccacagggtccccgcccctggagcaccccgctcgggtccgcccagctccaggtactggactgctgtcgagcaccaccgctatgtggaggccatggcgcgcttcgcggatcaccccgacctacttgcgcgcgcggctgcccacatcgggacccgcacgtacaaacaggttgactcccaccgcaccaaggtgatcgcggcggagcgcgagggccgccctgtccgcacgctcgaccccacgatggactggcgcatgcggccctactgcgccagcaccacggcccggtggctggctgagcaggggcgtagcccagtagcgccccgctcgccctgccccgagccccacgccccgccgcctgcagccgcgctgctgtacatcccggccacgccccccgcgccaacgccccgtgccccagtggcgcctcccaagcttgcgcctcccgccgagagcaccgtgcccgccacgcccgatgggaatccggaggcgccagcacccccgtttagcgcccccggacctcccacccccaaggcattgccgcccccgcccccgtcccgccgcaacctgcgccctcacctcgtgcccaaggatgcttggcagggggtcgccgatgccgtcgcccctgccgcctcgcgcctcctgcgcacgccccttgcgcacctctccaccgagcagtgggccacgttcgaagccgccctcgccggcctcgaggctacgctccaccatgccgcccgcagtgcagaggcggtgcccacacgctgcgctagccgagcaagggaagacgccgagcgccaactccgtgaagcccgaaagacgcgtgagatctttggcaaggccgctgccctctacgcagccggcaaggaccccactgccaccatcgagcgcatccccccagaagtccgcctacacctgccaacccctggctcggctgaatggcccgccagggcggccgccgcccgcagggtgatccgccgtgcagtcgcgcgagcggaccggttgcgcaagcgcatgggcatcctcgatagcgaccgcgacctccaacgcctcttcaacgctaaccagaagaaggcagttcggcagatcctcgccccgtccaccaaggcgccgcggtgccagctagacccagccgccgtcgaggaggcctacatccagaccctcgccaagccgccgccgatcgaccccagccccccgtggaagaactccgtccagtggccccgcccgcccactgccgccgatgacggaggcagccccttcagcgtcgccgaggtccgggcccagctccgccgactgcccaacgggtccgccccagggatcgatggcataccgtacgaggcctacaagcgtacgaaactggacgccacgctcgcccatgtcttcgaggtcgtgcggctgaatgcgcgcctgccagctcgatgggatgtggcgcgcacggtcctgctctacaagaaaggcgaccctaacgacaccggcaactggcgaccgataagcctccaggtcaccatctataagatcttcacggccgccctgtcgaagcggctcatctcctgggctggcaagcacaacactttctccgcatcgcagaagggattcctaccggccgaaggctgccacgagcacgcgtttgtcttgcgaagcgtgcttgacgacgcccgtcggcacaagcagaacgtgtaccttgcctggtacgatctgcgcaacgccttcggatcggtgtcgcacgacctcatcgcctggtgcgctgccatgttgggcctgccccgctacctccgggatgccatcggcgcaatctatcggcactcagcgctcttcgtccaagttggggatcaggagaccaccggcgtcattcctatgcgctgcggcgtcaagcagggctgccctctcagccccctcctcttcaacctgtgcgtcgagccggcccttcgctgcctacgccgcaccaccgggtacaagttctacggcacgtcgatcaccgtcgagggccaggcctacgccgacgacctgctcactgccgcgccctccgcctaccatgcggcccggcaggtggccacgatcgaggaatgggccaactgggcgggagtctccttcgtcgtccaagccctctccctggatgcgccggccggcaagtgtgccgccctcgcgatcaacttcgaaggtggtctaatgcactctatcgaccctgccctcaaggtccaaggcgcagccatcccggccatgtcaagaaacaacgtgtaccgctacctcggagtacatgtcggtctcacagatgcgctcggccaagcgaacgagctcctcgagaaggcctcacgcgatgcacgcacgatctgtgcctctggcctcgaaccctggcagaaggtggtcgcaatcaagaccttcatcctctcccggctccccttcttcttccacaacgggaagatccagaggggccgatgccagcaattcgaccgcgagcttcgagaaaacctgcgggccgccctccgactccccgtctgcaccacgaacgccttcttccattcccgcgtggcctcaggcggccttggcatcctgcccatcgcggaagaacaacaagtctacctggcagcccacgtgttcaagctcctgacttcgccagatctgtcgatccgcgccatcgcccgacaccaacttgccgaggtcacccacgcgcgacacaccacgccagtccaggacggcgaagcgtcacccttcttcggatggctcatgcgggggcaggaggtcgcatcaactaccccctcgggtgacgtcagttcaatctggttcgcagctgcaggcgcctactcgaggatgggatggtcagtccgcgatgcactccacccgacgctgacagttggtccgggcgtccaattcgagggccgattccaacgtgccaacgtcatcccagctctccgggctagcgccttttcccgccatgctgtggaatggagtgccctccgcacccagggtcgagcagcagcctaccaacatgccgtccaccctgcaacgcaccactgggtccacaacagcgctggcctgacgaccaaggagtaccgattcgcgatcaagtgtcgattgggtctcctgccgacgcgagcagctccacaccaccgcaatgggccaacagcgtgcagggcgtgctcctacgcccgcgagacggccaaccatgttctcggacactgcccggcgaccaaggccgaagtcatcgcgcgccacaacaggatatgccgagctctggcccaggcggctgaagcctcatggacgtctgtccttgaagacgtcccgatcccgggggtggactcccccctacgacccgacatctactgctctcggccgggccagtgtgccatcatcgaggtcgcggtctcctacgaggacgccttcaacgcttcgatggagggccgggcgaagcagaagaccgacaagtacgctggcctggctgctaccgtcgaggagcagctgcggctccaaacccggcacgcggctttcgtggtgggcttctctggcgtcgtgctcccagcctcggtaaccgctacggccacctcccttgatctcccccccaaaacttggaatgtgcttcttaaacgttgtgttgctgcctcaatcaaaggcagttacacagcgtggagaagattccggcgctctactccataacaaccatgtatggtgaaccacacctctctcgatcttgtattctgtgattggacatcagagttcctgcgaagggatacactctgccaatctcgtgggttgtaataaatccacaccttcaaca

SEQ ID NO: 1057 - DNA, 6514 bp, Acromyrmex echinatior
ggtgcacaacggatgcatcatacgtgtaccggagcatacgggctgtcacggcggctgcatgcgcgatctagctcggagattttatttatttatttattaatttatttatttattcatcgagtgtgagtgttcgcgttttgccgagaagcgattttcgttaagtgatacgcgccgcgttcataggttaggtgtgcagtgtacgtggctgtcgtcgcgaagattctcgaagattctacaagttcaaatttccgttaaatttcgttaaagttcctaaaaccatcgtgatcgggagtgcgttccaaaaatcatcagtttcggctcgttcgcaaaaccactcccggtcgacccgcgttccgaaaaccagacagccacgtacaagcaatacgattggtcggtacactgccgcgagtgcgaataactatttaactgttattattactggaaattacactgtattcgcccagtggatctgttatcgcgagtgcacttggcttttaagtaaatttgttaattttttcttaactataattggatactttttccaattgcggctcgtcgttatttatgaggggccagtkatctaaggcccttttagtcagactaaaccgtagtgcactcgccatggcggatccacaagtgcactatatagactacccgctgccccctagagtcaaatgcgtaaaatgtttcggtgctgagggggcaggcaaagtaaagggcgaatacagcgacccgccgcatttagcaaaacatctgaaaaagtgccacccgggagacacattaaattataaatgctcaatttgtgatctaagggggaccggtaaatacccccttagagatgttaaggcacattacgccgagtgccatgtgtctcccgcagtggatgcggcgggtccaagcactcgcggcagcctcggcgagtgcagtggtgcgggtcaaccgacagccagccgcgcggctaaagcgaccacgcgattggcggagacggttgggggtacggataagcgccgtgccgcgacatcgggatcgcggcaactcacgctgccgttcgcagccaccccatcgccatccacagcagccggtgaggcaagggccccaagaagcgmgtcaacgacaccgacgagcaggtccccctcatatgcggcagtcactgcgggcccgccatcgatgaggagcacgacaacttccaccacagcccgcagtaagactgtcgcgaaaggcgccgcgcccaacacmacgacgacgacaacggccaggagatccggcgaggccgccgcaacgaggaagccgcctacgaccgccacggtgagtaaaccgcgtgtgttgtcggtagaaactgttaggttgcctgtcgacgacatccagcgagcaggcgtgcaaaacgcggccaaaccggcgcgcgctccctctcgccccccgcagagaacatcaccggaggcggggggtccaagaacaacgggcgcaaaggagaaatgcggagagggagcatacaagaagttgcccgcaaacagcggcaatccaatttcaaccaggacgaggcgggcaactagcgtgccggttgagaagagcgaaggcacggcaagacgggagcgcgtctccccacaccctcctcccaaaggaattgatatcatcctatcgtcgacatcggaggaggagggcacgccataccagcccggcggcgtggggagactaagactaaggaggaaaaaggtgaccggaccacccccaaagatgacacccagagagggggtggtcacaagagccaggcggtccaccagcgctcccgtcgagaagagtgccttggatgcacgcctgacggctctggaccggacatcgtccagagcgacaggcaacccgacgtcgcaaatcgcagggggcctttacaccagtagaggccaaccggagaggacgccccctgcgaggctccccagcctgtctccgaccaccagaggcagtccatcggggagcctaggcgagatacggacacccatctcgcctgcgacgtcgctaccggcaacgctcaccacttgcacggtgacgacgaccacctgtggaagccccataacatccacgggcttcacaggtggcgtggggaggctgataacaccwccgagcctcccccaaacgaacatcctcccgaccatcggggaggaaggaacgtcaccgtgcgtggcggtcgtcaccacccatccttaggcggcaggagcacgtctccgctcatcctaccaaggccaacgacaccggagcctgagcggggacaagaggagcggcggctagaaggcgcggcgcagccacctaccacacccgtcgtcgagggggacaaccagtgggatggccagtggacggtgagcgtgaggagaagagcgaggaggcaacaactgaacgatacatccccctccaactccgagtccccgccaaccgctggaccatcgcgttcgccgcgcatagccccactatctgcgctgatagcggcgtcgacgagccgccatgagaccagcttaaatctcaattgcacgaacggcaatatttgcatggaccgaactccgccccgtaacattttgccggtargggcggagcgccgtcgcgagacatcgccacaggatcgcgtggagggagacatcggttatggtgctggaaaggtaagtgccgaacacccgagtgctcccgtaaatgtccgtggtgtgatgtctcgagggagagcaaccgcgtcatccatcgtgccaccgcgagccaaccgtggggagggcggtcggcagcatcatagtcggcggcgtccggacgctcctgtcggtcagccgtcgcgggatcacccggcgcctgcgactgtcgcgaggcagcgtaggcgtgagcgggtggccgcccgcgacgcgctgctcgatcgggctaaggacgtcgctacgattgcggatctggaggcgttcgcggcttcggtcgcggcgttcttcggggaggatgcatcggccactggtgctgcagcccgcgctcgcgatcgttcggtacgctcacgggaggcgggtgcgcgtcggggggtgaagggaggtgagcgtccggagagagagggcgccggtaggccggggtcagcgccggctgaccccggagcgtcgggagaagcacgcggggactgggtgcgcgaggccaaacgcttgcaggcgctgtacagggcgaaccgccgcaaggcagtgcgagaggtgctccagggacctgccgatcagtgccaggtgcctaaacgtcaggtccaggagtacttcgagcggctgtacagcggcggggaagacctggctggcgccggcgtggaagccgaacgccctgacccctcgagtccgcgtgaggtatctgcggtcctgggtccgctcgcggagcgagaggtggaccgtcggctccggcgtatgaataactctgcgccgggtcccgacggtgtatcctatcgtgacctccgtggggcggaccggggagcgcggctcctcacggcgctctacaacatctgcctgcggctcgaggcagtccccgcgtcctggaagacctccaacactgtgttgatacacaagaaaggagaccggggcatgttggagaactggcgccctctcgctctgggggacaccgtccccaaactcttcgccgcgctcttggccgaccgattgaccgactgggcggtcacccgcgggaagctctgctccgcgcagaagggcttcctgcgggacgaggggtgctacgagcacaacttcgtcctgcaggaggtcctgacgcacgccaagcgctctaagcgccaggcggtcgtcgcgtggctggacctgtccaacgcgtttggatcgatcccgcacgcgacgatccgccgcgcgcttataagatccgcggtgccacggggtctcatagcgatatgggactccatgtacgatggttgcacgacgagggtgcgaaccgccgagggtcacacagcacccatccccatccggtcgggcgtccgtcagggttgtccgctaagccctattatcttcaacctggccatcgactcggtcgtccgtgtggcggccgagwcgaatgacgggtattccctccacggaaatacctggtcggcattggcttacgcggacgacatcgcactactggcccagacgcccgaggggatggagaggatgctagcctctgtggaggcggaggcagcgtcggtggggctgcggttcaaccctgcaaagtgtgccaccctgcacgtcggtgcggggaatggcggcagggtcctaccgacgtcattccaaatccagggggagacgatcaaccccctggctcagggtgagtcgtacacccaccttggcgttccaacggggttctccgtggaccagacgccctacgccgccgtcggggacatcgtctcggacctgcgcgctgtcgaccgctcactccttgccccgtggcagaagatagaaatgctggggaccttcatcctatccaggcttgactttctgctccggggggccagagtgttcaagggtcccctcacggccgtggaccttaacatccgwaggcatgttaaatcctggcttaacctccctcagcgagcaagcgcggagggagtctacatgccgccccgttgggggggatgtggactcctgccgctctctgacctcgccgacgtcctcacggttgcccacgcgtaccgtatgttaacggtgcgcgatggcgccgtgagggagttggcgtgggaatcgctgaggggagtggttgggcgcaggatcggccacgcccctagttgcgaggatatcgcctccttcctatccggctcgctggatggaaggatgaggggcggaggggaggcttcgctctggtcgagtgcgcggaacgctgcgctcagacagtccgagaggttgtccctgcgttggcggtgggtcgaggccacggaggagatgacgttggagtgtcgagggcccaggggggcagcgattaagattccgcctgaagcgcgcggtcaggtagtgaatcggttgcgctcagctgtagcagagcactacgcaagtaggttgcttagcaagcctgatcagggtaaggtcttcgaggtgtcgtcgcggagccgagtgagcaatcactttatccgcggcggcagcttcactcgcttcgccgactggcgctttatccataaggcccggttagatgttcttcctctcaacggcgcacgacgttgggaggccaacgacaagcgctgtcggcgatgcggtgaggtatcggagacattaccccatgtgctctgtcactgcggcatccactccgccgcgatacagctgaggcacgacgctgtcctgcaccgcctttggaaggccactcgccttccaggggtagtgcgggttaaccagcgggtggagggcgtcagcgacgaattgggggcgctacgacctgatctcgtggtcaggcacgagccctccaaaagtgtcgtcatctgcgacgtcacggtgccattcgaaaaccgctggaccgctttcgaggacgccagggcgaggaaaatcgccaaatactcgcctctggcagaggagctacagcggcgagggtaccgtgtcgtcgtgacggccttcgtcgtcggcgccctcggctcgtgggatccgaggaatgaggcggtgttgagactgctgcgggttggcaaccagtatgcagctatgatgcggcgcctcattgtctcggataccattcgctggtcacgcgacatatatgtggagcatgtgtccggcacccgccagtacctggctccttcccgtccctctggggatctcgcgacgccgccgagagcggttcgtcgacgctggctcgccgaggagagaagcgcacaggacgcggcgcgtcgcggttcggatagtgtgagtgtcgcgtaaattattttgtctttgtcttggccccccctttttaaaccaagcaggagagagtggcccaatgcccaactattatatattaactatttactgtgatatttattatttgactgttgggcgggcccctctctgctggttttatttatatatattttttactcgcgtactttttgtactactctatttttctttttattttagctatgctatttttatctctttctttgtctctattttctttctttttttctttccttttcttttctttcttttattcttcttttatttatctttttttcttttctgttgtggggccctgaccgtccgagtgtgaatgccgcgaaaaacaatattatgttttatacgagtgtgcatgtgcgtgatatatttatctattttattttatttatttattataatttattgccgcgcgcgctcctccgggacttttattcgttgacaatactgtgatatttttctgckcaggctgggggggcttgccccccagccccttagttttaattgcctatgcggggggggcttttgtcccccgcaaatgtatatatatatatatttagcgcgcggcttagccgcttttgtttgtattaccccagaggggaattgtccctctggggaaaaaaaatgattggaaaaataaagtgagctaa

SEQ ID NO: 1058 - DNA, 4729 bp, Alligator mississippiensis
tgctggaaagacggagaaccgcttcctttttccctgcgcctggcctggtattgcagtacctccaggattagcgccaactagtccggcagactgtcggaatacagcaatagaaagwgagctgactagcagcttgctttccttcctccggtgcagcatgggttctcgtcagtcmtgacgggctagggaaggcggtgctgccagtacgtccgaaagagtgccggttgcgcaagcgaccgcgccactcaggtgagtagccaagggtcttacagttcaccggacccgawaacgcgaaaaccccaactcgggctagtagccgaagacctgggtcccccccmggtcagagtaggcgaacgccwgkgctcagaggacggaacgcggaaaacacccccaggtcccaaggacgccctgatccactgacaagaacgctcgaggcacgccaggagacccccagctagggtggaccgccgactgcaggtccggaggaccctcccaggagggtggaccagcgaacccaagttggcgacgaaccctgacgcaccccccacgatgtcaggaccccgacaggcggcggtggaccactgaccatcgaccgacccccagaggcagagagactctcagagcccggaaccccggctgacgagagccgcctcccggcggaggaccccggagcctgaggatgccccccggatgacggcggagcgccccgagcgacagcggacccctccggacccccacggcccctcggtgacgatggcgggccccgaacgacgacgacccccggaccccggcggtcccgaggacgccccccccgagggtctccccacgctggtggaggagccccggacccccccgacaccggacccccccacggacgacccaggcgaaggcgtagacatgacagcactcacgttcctccccttccccctcccggcgaagctgttctgcccgacctgccacccgccaagacagtacaggtcgcacggcgacatgaacaagcacctacggcgcttccaccagctgcgcctagccttctactgcgccctctgcggcaccgagtacgaggccctgaagctcctgaagaaccaccagaagggatgcgagggccacggagccgagaggagacccggcacgctggtgaggtccgctgccccggcccgccggacccaggccgcggtgcgaaggcccgccagactggccaccccgccgacaaccccaccggaccagacctccagggaccacccgacggagagacctgccccagtgatgccaccacgcaggcctccgcccagggacccccaaccggacacgacgccccgaccagacagcccccctcccagacccccggggccacccgatgcccccgaaccgccggggatcccggagccgcccggaggaaccgagccgccgggagccccccgkcccccgagcgtgccagggtctccgggtgtggagccctccccagcagaggatgcccaccccatggcaaaccctctggctggaggagctctcccgggccaccaccttcaaggccttcgaggcctcggtggcccggctcacagaggagctctcggcggccgcccggcccggccagccccgggggggcaacaacagaccggcgacgcgacgggaccacagactgcagccgcagaggcgacccaggcgccagcgctacgacccggcggcagcctcccggatccagaagctgtaccgggccaaccgtcccaaggcggtgagagagatcctggagggaccctcggccttctgccaggtcccccgggagactctgttcaactacttcagcagggtcttcaaccccccagcagaagccgccgccccacgccctgcgaccgtcgaagcgctgacccccgtccccccggcggaggggttcgaggatgccttcacgccgcaggaagtggaagcccgcctcaagaggaccagggacaccgcccccggcagggacggcatcaggtacagtctcctcaaaaagcgtgacccgggctgccttgttctttctgttctcttcaacaggtgcagagagttccggcgcacgcccaccacctggaagagggccatgacggtcctcatccacaagaagggagacccgaccgacccgggcaactggagacccatcgccctgtgctccaccgtcgccaagctgtacgccagctgcctggcggcccgcatcaccgactgggcggtgaccggcggggccgtcagccggagccagaagggcttcatgtcgacggagggctgctacgaacacaacttcaccctccagatggccctggacaatgcccggaggaccaggaagcagtgcgcggtggcgtggctggacatctccaatgccttcggctccgtgccccaccgccacatcttcggcaccctccgcgagctgggcctaccggacggcgtcatcgacctggtgcgagagctctaccacggctgcaccacgaccgtccgcgccaccgacggagagaccgcggagatccccatccggtcgggggtgagacagggctgccccctcagccccatcatcttcaacctggccatggaaccgctccttcgagccgtggcaggcggccccggcgggctcgacctgtacggccagaagttgagcgtcctggcctacgccgacgacctcgttctcctcgcccccgacgccacccagctgcagcagatgctggacgtgacgtccgaggcggccaggtggatgggcctgcgcttcaacgtcgccaagtgcgcctccctgcacatcgacggsaggcagaagagccgcgtcctggactccaccctcacgatccagggccaggcgatgaggcacctgcgcgacggcgaggcctactgccacctggggacgcccaccggccaccgggccaagcagacgccggaggagaccatcaacgggatcgtgcaggacgcccacaagctggactcgtccctgctggccccctggcagaagatagacgcggtgaacaccttcctcatcccccgcgtcgcgttcgtcctgagaggctcggcggtccccaagacccccctcaagaaggcggacgccgagatccggcggctgctcaagaagtggctgcacctgccgctgagggccagcaatgaggtcctgcacatcccctaccggcagggaggtgccaacgtcccccgcatgggagacctctgcgacatcgcggtggtcacccacgccttccgcctcctgacctgcccggacscgacggtaagtatcatcgccgccagcgccctcgaggagaccgcccgcaagaggatcgggaggcagcccaccagacgtgacttggccaccttcctcagcggctcgctggagggcgagttcagcagagacggcggggactttgcctcgctgtggagccgagcccgcaacgccacgcgccgcctcgggaagcgcatcggctgcgcctggacctggaccgaggagcgccgggagctgggagtctccctgcaaccagccccgcacgccgaccgcgtcaccgtgacgccccgcacgaggaccttcctggagaggttcctgaaggacgccgtccgaaacaagtacgccggcgacctgagggccaaacccgaccagggcaaggtcttcgacgtcacctcgaagtgggactccagcaaccacttcatgcccagcgggagcttcacgcgcttcgcggactggcgcttcctccaccgcgcccgcctcaactgcctgcctctgaacggggccgtccgcttcggccaccgggacaagaggtgccgacggtgcggctacgtggcagagaccctcccccacgtgctgtgcagctgcaagccgcacgccagagcctggcagctctgccacaacgctgtccaggaccgcctggtgagggccatcccggccgcagcgggggagatctccgtgaaccgcaccgtcccgggctgcgagagccagatgcgccccgacatcgtcatcaccaacgaggaggccaagaaggtcgtgatcgtggacgtgaccatccccttcgagaaccggcgccaagccttcaccgacgcccgggctcgcaagcgggagaagtacgccccgctggccgacatcctgaggggccgcggctacgacgtgacggtcgacgcgctcatcgtgggaacgctcggagcctgggaccccagcaacgagagcgtcctgcatgcctgccgcgtctcccgccgctacgccaagctgatgcgctgcctcatggtgtccgacaccatccgttggtcccgtgacatctacgtggagcacatcacgggccaccgccagtacaccgaccccaccagacgaaccgccgccggaccggacccagaggggaccgcctgaaccccccctctgcaccagatggaccttcacttcgagaggattcttcagcaatggacgaccccgctccacccgaagaggacccccgcgatgagactctatatggactgagacactttttcttcgaaccacttcctccaccattgcggaccattgtaacgggtttgtgtgtatctatcttctttctctctcagcgtcgcgaaccccctccctccccttcccctccccctcccccccacccccgggcttagttggctaacattgtatctcctgtaacctagttgcgttcccctcctcacccccatccctctattgttagtccctcgctcgggcgctctgtatttccctaccggctttgtcatcttttttggattcacaatcctaaacatctactaataaaagtcaatc

SEQ ID NO: 1059 - DNA, 5031 bp, Chelonia mydas
  modified_base (1806)..(1806): a, c, t, g, unknown or other
ctcttcttatgaatacttgcaacacctgcactgaagatggattctccggctgctatttttgaaaaactgatgctgctttgaaggtgtattctgctgctgctaccttggaaggaaattctctctctgctcctgagacatccccagctgcaccgtgtaccaccaccaccactgctgctgctccacagaaggtttctcggacaatgactacaaagaaggtcctaggtgcctccacaacattacagaccagcagcacgaaggggaagaacagtggctgctcaaaggaccccctccgagatgctgttccaggaagatcctggattctgaggccggcctgtcgggacatcacaaccagaaggaacatcccccccgccccccagcagcagcagccgccaatggagagcccccccactctgcagctgcaagatgctctcaggcgaccatctcccacccccgcagctgcccaggtcgctgacgctggtggtgctctcgctgctctacacaccatcaagagaggaatctccgtagactggaccagcatctctccaaagascmcccagaggstcaccagcgcctcgccggatgcctgcccagcctcagaaaccacccagagggaccscaggwscctgctggacgcccgcccagccggacctctcgaccctacccgcccacaccaggatgaaccagccagcgataccgctgatgctgctggaacccccctgctgcaaggtaatgaggacaccatctacctgcagtatcccctcgctgcggacatgctcatctgccccatctgctctccgccccaaagcttccacctcctcggtgtcgtcaccaggcacctgaagagatgccacagcaagcgggttgccttcagctgtgccctctgcagcctgcccttcgagacgcagaagcaatgcaagatgcaccaagtcgcctgcaggaaatgcctcaagggaacmacacagtctcctgccccggctcccagccctcctgctgcacgccggcccgctgctcctgagcctcaacgaagaaagscgacctcgcaagctgccgtcaagaagcctgcccccgtcgccaggccagcggaacgggatgctgcgatcgagaaggtacctgctgcctcggggaacatcacccaggtcctcgccagcaggaggcccgtctcaccctctcatgtcgccaagmagatctccatgctgagacgactcagtgctgcctcgccacctgtccagcacgtccccgtccccagaaggatcagcgccccaccgcgcatagctgctcgagatcctgtcgccggaagagccagcgccgcccctcagaccgccctgcgaactccagccgccggaggagccagcaccacgcctcagaccgccctgcgaactccaaccgccggaggagccagtgccatgcctcagaccaccctgccagmccccagacgtccagactggaggaaccagccccgcagccacagcaaagcaccgggccttcatcgccagacggaccagcacggcccccaagtccattctgcgggacactgcctacgggagatctcacgctccagcagcaaccgcctaggcagcagccactcatagaaggaccggcggtgtcccagcaacccccgagccggaccgcgtctctccgaccaccagcaacgccascatcccgccagagatcccgccccagcacccaaccgaagggaatcctgacccacgagatagacggcaggccgaccatacagcaggctcwgagcctgcaccagacgaggtcgaggaccmtgagggccagcggccgatggtgagggctgccacnccgtggcagactgcctggaccgaggagctacaagcggcagcttcctttgacgacttcgacctcctcgtagacaggctcacccgagaactgtctgcggaaatcgctcccaggaggagttcgaaccaggagaacgccccgcctgcccacagaacgcctgctccgaaccacaacaccaccaccaggggagccagaagtagagacgccagccgccgctacgatccagcagcggcttcaaggatccaaaagctgtaccgggcaaaccgctccaaggccatgagggagatcctagacgggccctcgccctactgcacgatcccatctgagcgtctctacagctacttcaaggatgtattcgaccgcatagcccggaatgacgcgcagcgcccagagtgcctccgccccctgccccgtgtcgacgaagcaggtgtcctggaaactgactwtacgcccaaggaagtgatggccagactctcaaaaacaaaaaacacagctcctgggaaagacggcatcccctacagcctcctgaaaaagcgagatcccggctgcctggtcctcgccacgctcttcaaccagtgcaagcgattctgccggactcccagctcctggaagaaggccatgacggtactggtgtacaagaagggcgagcgggatgaccccagcaactggaggcccatctccctctgctccacgatgtacaagctctatgccagctgcctggcgtcgaggatcacggagtggtcggtgagcgggggagccatcagctccatccagaaaggcttcatgtcctgcgagggctgctacgaacacaacttcgtcctccaaaccaccatcgaaacggccagaagggcgcggaggcagtgcgcggtagcgtggctcgacctggctaacgcctttgggtccatgccccaccaccacatctttgccacgctccaggagtttgggatgccagagaacttccttcgtgtgatccgagaggtgtacgagggatgcagcaccaccattcgctcggtcgaaggggagaccgccgagatcccgatccggagcggagttaagcagggctgtcccctcagccccatcatctttaacctcgccatggagccgttgctgcgagcgatctccaatggcacagatggcttcaacctccacggtgagagggtgagcgtcctggcttacgcggatgacctggtcctgaccgcggatgacccagagagcctccaaggtatgctagatgccaccagtcgagctgccgactggatggggctccgcttcaatgcaaagaagtgcgcaactctccacatcgacggcagcaaaagggactcggtgcagacgacggggttccagatccagggcgagcccgtcatccccctggcagaggggcaggcgtaccagcacctcggcacgccgacgggtttccgtgtccggcagacacccgaggacaccatccaggagatcttgcaggatgccgccaagatcgacgcctccctgctagcaccgtggcagaagataaacgccctgaacaccttcctgatcccccgcatctcgttcgtcctaaggggatccgccgtggcgaaggtacccctcaacaaggcagacaagatcgtccggcagctggtgaagaagtggctgttccttccccagagagccagcaacgagctggtctacatcgcccacaggcatggcggtgccaacgtcccccgcatgggcgacctgtgtgacatcgcggtgatcacccacgccttccgcctgctgacgtgtcccgacgccatggtaaggaacatcgcggcaaacgccctccatgacgcgacaaagaagcggatcggcagagccccctccaaccaagacatcgccaccttcctgagcggttccctggatggcgaattcggacgggacgggcgcgacatcgcttcactgtggtcccgcgctcgcaacgccacgcgtcgcctggggaagcgcatcggctgccgctgggagtggtgcgaggagcgccaggagctgggagtcctggtgccgcagatcaggtccaacgacaacaccatcgtcaccccgagcgccaggggcatgctggagaggaccctgaaggcagccatccactcactgtacgtggaaaccctgaagcgtaaaccggaccagggtaaagccttcgaactgaccagcaagtgggacgccagccaaccacttcctcgccgggggcggcttcacccgtttcgccgactggcggttcatccaccgtgcccggctcaactgcgtcccgctcaacggagccgtccgccacgggaaccgagacaagcgttgcaggaagtgcggctactccaacgagaccctgccccacgtcctgtgcagctgcaagccccactccagagcctggcagctgcgccacaatgccatccagaaccgcctggtgaaagccatcgcaccgcgcctgggggaggtcgccgtgaactgcgccatccccggtactgacagccagttgcgacctgacgtggtagtcaccgacgaggcccagaaaaagatcatcctcgtcgacgtcacggtctcctttgagaacaggaccccggccttccgcgaagcccgagctcgtaagctggaaaaatacgcccccctggccgacaccctgagagcgaagggctacgaggtgcagatggatgccctgatcgtcggagccctgggcgcttgggacccctgcaatgagcgtgtgctgcggacctgtgggatcggtcgacgctacgcacggctcatgcggcgcctcatggtctcggacaccatccgatggtccagggacatctacatcgaacacatcaccggccaccgacagtaccaggaggtgtgagccggtacgacatcgtgcatcaactatgagaaagggactgagagactttttccattggaccatatgaactggaaccataaactcactgaacattaaatctcaccaaatgagggtaaatccatcctcatcatcgtatccactcattatactccacacctgaacatagccattatatgaacaacatacccccatatctcaatgtctgtactttgacccgttaaccttttacccccaatcggggatattgcagattatgtattccttacgccacccgatcctaaaccgaatttcgcaccccttgataatctgtaccttattccctgataaccagaaacttctatgcttaaactctgtaccgtttttttttatttcaacatcatcttaataaaattattaaa

SEQ ID NO: 1060 - DNA, 5122 bp, Chrysemys picta
ttttttctgatgcttgactgcaaacacccatccagaagatggaatctcctgcagccatttttgaaaaaattgatgctgctttaaagatatactccattctcctwktttgkaagaaaactctttttcagcttcagctattctgtcatcggctgctgctgttcctgcttcccagaaagctcagcmaaaacctatcctgaagaccwcccttggtgcctcacggaagacccggascacctgcaagaaccaaaacattaggagctggctgaagaaaccccccgtggatacctcwgcagggagacctggstccagmaggacakctcttcgggacctcmcatcsaggagcaagaatatctcaacagctcttcaggagggggacccccggagaaccctgcccgcttcccagaaccaggatgctgatcgccgccccaccgggaaggatgccaccgcaggagcccccccaatgacccaggaccaggatgctgattgctgccccgccgggaaggatgccaccagaggagcccccccgatgacccaggaccaggatgctgatcgctgccccgctgctccagagagggatgctccggaaggaaccacctcctcaaccccagaccccaaaactacttaccacccggctgtccggaggagggccgctcgaaggggaatgcacctcagagcccaagatctcgatgccgcacgctgcccttccgggcaaagagacaacgtggccagtgagtccagcgcccccccaagagcgacttcacctccccaagcttctctaccagacccagaggaatcacctggcgagtctgcaggcacaacagagatccgccccacggagggtgaggcaggggaagaagaccgcatctacctccagtacccgctccctacaggtctcctcctctgccccttctgtctccccgtccatggagtccagaccctcgcggccctcagcaaacacgttcgtaagacctacaacaaacggattgctttccggtgtagccgctgcgatctccccttcgagacccaaaagaaatgtaagtttcatcaagccacgtgcaggggaccccccacgaccgcgaaagtgaatcccactgacatcctccgggttccaaccctgacccccaccgatgatctggcttcagcaccccagccagcatccccagagtcacagcagataaggggggaccaaccgccaactgagggaagcgtaacccccgcctcgaggactgacgatgccaccaaaaggaccagtcccgtctccagaatccccacgctggaccctgctgtgagggggaccaccgccacctctcaggtcaacaacctcaccagacgcctcagcgacctcataaaaaccatccggcacaacacggacacgagacgctgcagcgctcccccacaggtaacctcatgccgccctgccgtaggagcaactagcatcgtcccccaggctgcacggcgagatccagccaacggaggagcctcccgtagcccccagatcccacagccagaccccgcccccgggagacccaacacctcctccaaggttacccaaagagcctctgaccgccaaaaaccccatgccccaccgaggacccaccagccggatgccgcccgcagaagaaccagaaccatccccagcgcttccaaacacgaccgcgccccgacaaagcccagcaccggtgcttccagaaccccactccctcccggaagatccagtgctgcctcggagacaccgagagctgccctccccaccacaccaggacccccgcctcaagacccacctgaacaccgctccacagtccgagggacaacaaggccgcaaaccgtccccgcagcacctgaacctgcagagacaacgcagcaggaggagcgacggccacgagcgagggtcgccacgccgtggcaatccgcctggatggaggagctggcaaaggctgaggactttgagaacttcgacaccctgatggacagactgactgcagaactgtctgcggaaattacggccagaaggagggaaccccaggaagccgcacgggccactcgcagattccctgcgccgagccgtaacaacaccgccagagaaggcaggagaggggacgtcggccgccgctacgatccggcggctgcatcccgtattcagaaactatacaggatgaaccggacgaaagccatgagggagatcctcgacgggacctcctcctactgtgccatccagcccgagaggctctactcctacttcaaggatgtgtttgatcacgaggcccagaccaacttgcgacgcccagagtgcctttccccgctaccccggatcgacctcacggaggacttggagcgagatttttccccgcaggaggtgcaggcgaggctgtcgaggaccaaaaacaccgcccctggaaaagatggcatccgctaccccctgctgaagaagcgagaccccggctgcttggtgctcgctgccatcttcaacaaatgcaagcagttccatcgcgttccccgctcctggaaaaagtccatgaccgtgctcatccacaaaaaaggcgamcgagacgaccccggcaactggaggcccatctccctctgctccaccatctacaagctgtatgccagctgcctcgcggcaaggatcacagactggtcagtgtgcgggggcgccgtcagctcagtgcagaagggtttcatgtcctgcgagggatgctacgagcacaacttcctccttcagacggccatccaggaggccaggaggtccaagaggcagtgcgcagtagcatggcttgacctgaccaacgcctttgggtccataccccaccatcacatctttgccaccctgggagagttcgggatgccagaaaccttcatccagatcctccgggacctctacaaggactgcaccaccaccatccgcgccacggacggagagacggacgccatccccatccgccgcggcgtgaaacaaggatgcccccttagccccatcatcttcaacctggccatggaaccgctcatccgagccatctccagcggcccgaccggcttcgacctgcacggcaagaaactcagcattctggcctacgcggacgatctggtcctgaccgcggatgacccagagagcctccaaggtatgctagatgccaccagccgagctactgactggatggggctccgcttcaatgcgaagaagtgcgcaactctgcacattgacggcagcaaaagggactcggtgcagacaacggggttccagatccagggtgagcccgtcatccccctggcagaggggcaggcataccagcacctgggcacgccaacagggttccgtgtccggcagacacccgaggacaccatccaggagatcttgcaggacgccgccaagattgatgcctccctgctggcaccgtggcagaagataaacgccctgaacaccttcctgatcccacgcatctcgttcaccctaaggggatccgccgtggcgaaggtgcccctcaacaaggcagacaagatcatccggaagctggtgaagaagtggctgttccttccccagagagccagcaacgagctggtctacatcgcccacaggcacggcggcgccaacgtcccccgcatgggtgacctgtgcgacgtcgcggtgatcacccacgccttccgcctgctgacatgtcccgacgccacggtgaggaacattgcggcgaacgccctgcgtgatgcgacagagaagcggatcggcagagccccctcgaaccaagacatcgccaccttcctgagcggctccctggatggggaattcggacgggacgggcgcgacatcgcttcactgtggtcccgcactcgcaacgccacgcgtcgcctggggaagcgcatcggctgccgctgggagtggtgcgaggagcgccaggagctgggaatccgggtgccgcagatcaggtccgacgacaacaccatcgtcaccccgacggccaggggcttgctggagaggactctgaaggccgccatccgctcgctgtacgtggaaaccctgaagcgtaaaccggaccagggtaaagcctttgagttgaccagcaagtgggacgccagcaaccacttcctcgacgggggcggcttcacccgtttcgccgactggcggttcatccaccgtgcccggctcaactgcgtcccgctcaacggagccgtccgccacgggaaccgagacaagcgttgcaggaagtgcggctaccccaacgagaccctgccccacgtcctgtgcagctgcaaaccccactccagagcctggcagctgcgccacaacgccatccagaaccgcctggtgaaagccatcgcgccacgcctgggggagatctccgtgaactgcaccatcgccggtaccgacagccagctacgacctgacgtggtcgtcaccgacgaggcccagaaaaagatcatcctcgtcgacgtcacggtctcctttgagaacaggaccccggcatttcgcgaagcccgagctcgtaagctggaaaagtacgcccccctggctgacaccctgagagcgaagggctatgaggtgcagatggacgccctgattgtcggagccctgggcgcctgggacccctgcaacgagcgtgtgctgcggacctgcgggatcggtcgacgctacgcacgtctcatgcggcgcctcatggtctcagacgccatccgatggtccagggacatctacatcgagcacatcaccggccaccgacagtaccaggaggcgtgagccagagtgacatcgttctcccactacgagaaagggaccaagtgaccttctccgttggatcatatgaactggaaccataaactccctgaacattaaatctcaccaaatgagggtcaatccatcctcatcatcatatccactcattatamtccacacccgaacacagccactctatgaacttcataccctcatatctcaatgtctgtactttgacccatcaaccttttacccccaatcggggatattgcagattatgtattcctcatgccacctgatcttaaaccaaactttgcaccctcgataatctgtatgttattccctgataaccagaaacttctatgctcaaactctgttcactattttttttaacatcatcttaataaaatttttaaatctgtt

SEQ ID NO: 1061 - DNA, 3851 bp, Drosophila yakuba
aaagtgtagttcttttctgttttagtgtagtgggaagtctgtttctttttattatgttttttacgaaaaagtcctggtctttgaaattcattgtctaaattttaaataaaattataaaatttaaaaagaaaattaattaaagaagcgatgaaatatctctgaaattcaatcaatcaattaatcatggcgtctcagcgagtgcacgtatttgcctaccccttcgtgggaccattccggtgctccgtatgcatggatgcgtccgggatgcatcccactaggtcgctgggcgaatacggcacatacgctgcggcatatcagcacataacccggcgccacccacaagtggttattacataccgttgccgggtctgtggcgctgatatgccccggggtatgaagcagctcaaagcccatgtggccgcgagccaccccgagaccaccacagacgcccacgggatgcttgtggaagcagccacagccccgaaccctgccttaccactccccgccttctccccgagacagtcagcgctgagccctgtgacgacgagagccagcgaacgcggtacgcctctccccacaagcaggcgcgtactctgcacgacgccgagccgcgcgatgcttcccgggaacatgccccatcctgcgctgagccccgttgtcacaggtgccagtggacgcactggaaggactgttgcccccattccaccaacacgacagatggccccgagggcaccgaccgctgcgcagacaccatcaccagccccgcaacggccgcctgcccgcaacgttccccctgcccccttgggtcaagtaacgggtgtgacgagacggctcctgagaagcggcaaccagccgccgatctcgtccataccgccccgttcgccgtcctcgtccgtgccggcccgttcgccgatctcgtccgcgccggcccgttcgccgaccaccaccaggacgacgaccccctcccgcaccggtctgggagtctcggccccctctgctccaagcagaaggacccccgaaagacccaccagcaccgccacagcgggcaggccgggaaccaaacccacacggacatacccagagccgcccccagcagaagggccgcaatctgcctgatggccaatgccgcggccaccagggaggacctgctgagggccgccaccagcctttccgaaatggcggccgcgaaccagcctacccgctcgcccactggaggtggcgagcccacctcacagggtaggcgcggaccgcaagcactggcagacgcagcgaaaaggatccaacaaatatacaggaccaacatacctcgcgccatgagaaaagtcctgagaacactgctcacggcagtgtttagcgcctgcctgaggacaggtcatgtccccgatctgtgtaaaaagtccagaacggtcttaatccacaagaaaggsgacagaactgacctgtcaaattggaggcctctttccatgggtgacaccatccccaaattgttcgcagccgtcatggcggacaggctgacggcgttcctcactaacggaggaaggctcagcgaggagcagaagggcttcctccagcacgaaggctgccatgaacacaattttgttcttggccaagtgctggaggagagcagacgccaaggcaaggacctcgtcatgggctggctggacctgtccaacgcgttcgggtcgattccgcatgccaccatcatggacgcggtcgccggtatggggatcccttcgaggatccggaccataatccaccagctggccaccggcgccgcgaccaccgccaaaaccattgatggcatgtcggaagagatcccgatcgaagcgggggtcagacagggctgcccagccagcccaatcctctttaacatcgcaatagagcgggtacttcgcaaaatcaaaaccgtcaacgcggggtacctgctctatgggagccgcattagcccgctggcgtacgccgatgacctggtgctaattgcgagctccccagaggagatgaggtccttgctgcgtgctgcggacgacgccgcaatagaagccggtctgcacttcaaccccaagaagtgcgcgaccctacacctcacggggaagaaatcctcgcggagggcagtgcagaccggcttcctcgtccgtggcacgccaataccggccatgacagagggggatgcctacgaatacctcggcatccccctgggtttaaaaaaaaaccaaacacccagggcagcgatggaagcgatagttggggacatagccaagatagatgactcgctgctcgccccgtggcaaaagatcgacgcggcccgcaccttcgtggcaccgaagcttgacttcgtgctacgaagtggcgccaccttgcgggccccgctgcgtcatctggatacagtcattaaaaaacacattaaaaaatggctgtatctgccgcagagggcgagcgcggaggtagtatacaccccgctgaagaaaggtggagcgggcatactaccttcatctatattggctgatgtcctaactatcgcccaggctcaccgcatggtgtcctgccctggggaggtcgtctcccggattgcaagtgagggcctgagagaagcggtaaagcgaaaaataaaccgggagccatccggcgacgagatggcccactttctctcaggctccactctatccggggagacagccagctttggcgacgccggattctggtcgagggtgaggatggccaccaaaaggcaagctgtgcatctgggggtgcgttgggcctggagaggaggtgagctactggtcgagagtagaggacaaagaaaccgaccagtggccaccgactcgaactccaggtcccaactcatccaacgtctcaggtgcgcagctcaggatgagttcctgaccatcctcataaataaacccgaccaggggaaggtggcgaagctctccacgctaaccccagtcagcaacgcgttcatacgcgacggtagctttaccaggtttgctgactggcggtttatccacagagcccgactgggagtcctcccactcaacggagcgatccgatggggcagcggcgacaagcgctgccgggtctgtggatatcagctggagagcgttccacacgtgttgtgccactgcatgcaccactcaaacgcaatgcagcagaggcacaacgcggtgatggatcgcctcgccaaggctggctcacggctggggacccccagggtgaactgccgcgtggaaggggtcgccgaggacatggcggccctcaggccggacctggtatggcgcgacgaacggagcagaaaaatcgtcatagttgacgtgactgttccgttcgagaacggggctgaagcgtttgataacgcgaggggcgagaaagaagaaaaataccgccccctagctgaagccctgcgcgccatgggataccaggtaaaactggaggcattcattgtcggagccttgggctcgtgggaccctaaaaacgaaagggtccttaagactttgggtgtctccaggttttatgctggcctgatgcgcagactgatggtggccgacaccatcaggtggtcccgggacatttatgtggagcatgtatccgggatcaggcagttcaccctgccaagtggagctccctccaactaaaaaattaaaatgccttaaaaataaataaatatatcaaaatttaaaaaaaaaaacgaggaacaaataaacacaaattctgaaagatttatataatttaaaawataaatcgaaaataaatgttgaaaacaaaaaaaaaataataataataataaaaacacaataacactcacccggcctgccccagaggcaggtaaacatttactggccatatggctttttttttaa

SEQ ID NO: 1062 - DNA, 4739 bp, Gavialis gangeticus
  modified_base (325)..(325): a, c, t, g, unknown or other
  modified_base (444)..(444): a, c, t, g, unknown or other
  modified_base (749)..(749): a, c, t, g, unknown or other
  modified_base (785)..(785): a, c, t, g, unknown or other
  modified_base (836)..(836): a, c, t, g, unknown or other
  modified_base (1397)..(1397): a, c, t, g, unknown or other
  modified_base (1991)..(1991): a, c, t, g, unknown or other
  modified_base (2453)..(2453): a, c, t, g, unknown or other
  modified_base (3305)..(3305): a, c, t, g, unknown or other
cgctggaaagacggagaaccgcttctttttcctgcgcccggcctggtattgcacttcctccaggaccagcgccaacctagtccggcagactgccggaataatagcctcagaaagagagctggctagcagccctcttttctttcctccggtgcagcgtgggttcttgtcagtcctgatgggctagggaaggcggtgccgccagtacgtccgaaagagcgccggttgcgcgagcgaccgcgccgctcaggcgagtagcccaagggtcttacggttcgccggacccgataacgcgaaagccccgactcgggccagtagccgaagaccntgggcctccctccccaggtcggagtaggcgaacgcccgtgctcggaggacggaacgtggacaaaacacccccaggtcccaatgacgccctgatccactgacaagaacgctcgaggcacnccaggagacccccagctagggcagaccgccgaccacgggtcgcggaggaccctcccaggagggtggaccagcgaacccgagtcggcgacgaaccccgacgcaccccccccgcgatgtcgggaccccgacaggcggcggcggacccccggccatcgaccgacccccggaggcagagagactctcagagcccggaaccccggctgacgagagccgcctcccggcggaggaccccggaccccgaggacgccccccggacgacggcggagcaccccgagcgacggcggactcctccggacccccgcggnccctcggcgacgacggcgggccccgagcggcgacgncccccggaccccggcggtcccgaggacgacccccccgagggcctccccacnctggtggaggagccccgaacccccccgacaccggacccccccgacggacgacccaggcgagggtgcagacgcggcagcgctcacgttcctccccttccccctccctgcgaagctgctgtgcccgacctgccacccgccaaggcagtacaggtcgcacaacgacatgaacaaacacctacggcgcttccaccagctgcgcctagcgttctactgctccctctgcggcaccgagtacgaggccctgaagctcctgaagaaccaccacaaggtatgccagggccccggggccgagaggagacccggcacgctggtgaggtccgccgccccacgacccgggccgcggcgcgaaggcccgccagaccggccgccccgccggcgaccccaccggaccagacctccggggaccgcccgacggagagacccgccccggcgacgccaccacgcaggtctgcacccagggacccccgaccggacgtgacgccccgaccggacggcccccctcccggacccccggggccgcccgacgcccccgacccgccgaggatcccggagccgcccggngagcccgagccgccgggagccctccagctcccgagcgtgccggggtctccgggtgcggagacctccgcacagcagaggatgcccaccccgcggcaagccctctggctggaggagctctcccgggccaccgccttcgaggccttcgaggcctcggtggcccggctcacggaggagctctcggcggccgcccggcccggccagccccggaggggcgccgacaacggaccgacgacgcgacgagaccacagaccgcagccgcagaggcgacccaggcgccagcgctacgacccggcggcagcctcccggatccagaagctgtaccgggccaaccgccccaaggcggcgagagagatcctggagggaccctcggctttctgccaggtcccccgggagactctgttcaactatttcagcagggtcttcaaccccccggcagaagccgccgccccacgccccgcgaccgtcgaagcgctgacccccgtccccccggcagaggggttcgaggaggccttcacgccgcgggaagtggaagcccgcctgaagaggaccagggacaccgcccccggcagggacggcatcaggtacggtctcctnaagaaacgtgacccgggctgcctcgttctttctgttctcttcaacaggtgcagagagttccggcgcacgcccgccgcctggaagagggccatgacggtcctcatccacaagaagggagacccgaccgacccgggcaactggagacccatcgccctgtgctccaccgtggccaagctgtacgccagctgcctggcggcccgcatcaccgactgggcggtgaccggcggggccgtcagccggagccagaagggcttcatgtcgacggagggctgctacgaacacaacttcaccctccagatggccctggacaacgcccggaggaccaggaagcagtgcgcggtggcgtggctggacatctccaacgccttcggctccgtgccccaccgccgcatcttcggcaccctccgcgagctgggcctaccggacggcgtcatcgacctggtgcgagagctctaccacggntgcaccacgaccgtccgcgccaccgacggagagaccgcggagatccccatccggtcgggggtgaggcagggctgccccctcagccccatcatcttcaacctggccatggaaccgctccttcgagccgtggcgggcggccccggcgggctcgacctgtacggccagaagttgagcgtcctggcctacgccgacgacctcgtcctcctcgcccccgacgccacccagctgcagcagatgctggacgtgacgtccgaggcggccaggtggatgggcctgcgcttcaacgtcgccaagtgcgcctccctgcacatcgacggcaggcagaagagccgcgtcctggactccaccctcacgatccagggccaggcgatgaggcacctgcgcgacggcgaggcctactgccacctggggacgcccaccggccaccgggccaagcagacgccggaggagaccatcaacgggatcgtgcaggacgcccacaagctggactcgtccctgctggccccctggcagaagatagacgcggcgaacaccttcctcatcccccgcgtcgcgttcgtcctgagaggctcggcggtccccaagacccccctcaagaaggcggacgccgagatccggcggctgctcaagaagtggctgcacctgccgctgagggccagcaacgaggtcctgcacatcccctaccggcagggaggcgccaacgtcccccgcatgggagacctctgcgacatcgcggtggtcacccacgccttccgcctcctgacctgcccggacgcgacggtaagtatcatcgccgccagcgccctcgaggagaccgcccgcaagaggatcgcgaggcagccgaccggacgngacttggccaccttcctcagcggctcgctggagggcgagttcggccgagacggcggggactttgcctcgctgtggagccgagcccgcaacgccacgcgccgcctcgggaagcgcatcggctgcgcctggacctggaccgaggagtgccgggagctgggagtctccctgcaaccagccccgcacgccgaccgcgtcaccgtgacgccccgcacgaggaccttcctggagaggttcctgaaggacgccgtccgaaacaagtacgccggcgacctgagggccaaacccgaccagggcaaggtcttcgacgtcacctcgaagtgggacgctagcaaccacttcatgcccagcgggagcttcacgcgcttcgcggactggcgcttcctccaccgcgcccgcctcaactgcctgcctctgaacggggccgtgcgcttcggccaccgggacaagaggtgccgacggtgcggctacgcggcagagaccctcccccacgtgctgtgcagctgcaagccgcacgccagagcctggcagctccgccacaacgctgtccaggaccgcctggtgagggccatcccggccgcggcgggggagatctccgtgaaccgcaccgtcccgggctgcgagagccagatgcgacccgacatagtcatcaccaacgaagaggccaagaaggtcgtgatcgtggacgtcaccatccccttcgagaaccggcgccaagccttcaccgacgcccgggctcgcaagcgggagaagtacgccccgctggccgacaccctgaggggccgcggctacgacgtgacggtcgacgcgctcatcgtgggaacgctcggagcctgggaccccagcaacgagagcgtcctgcgtgcctgccgcgtctcccgccgctacgccaagctgatgcgctgcctcatggtgtccgacaccatccgttggtcccgcgacatctacgtggaacacatcacgggccaccgccagtactccgaccccaccagacgagccgccgccggaccggacccggaggggaccgcctgaaccgccccccctccgcgccagacggaccttcacttcactccgagaggattcttcgaccacggacgaccccgctccacccgaagaggacccccgcgatgagactctatacggactgaggcacttccttcgaaccacttcctccaccattgcggaccattgtaacgggtttgtgtgtatctatctcctttctctctcagcgtcgcgaaccccctcccccaccccccacccccgggcttagttggctaacattgtatctcctgtaacctagtcgcgttcccctcctcacccccatccctctattgttagtccctcgctcgggcgatctgtatttccctatcggctttgtcatcttttttctggattcccgatcctaaacatttactaataaaagtcaatctgttcttt

SEQ ID NO: 1063 - DNA, 4030 bp, Lytechinus variegatus
atctactatcatgtcttgtccaagagagggaagcgatcacctcggtcctgatcctgagacacccgccctccatcagggttctgacatccgggttaccagttctcgccttcgaggttcccgcggaaagagttctcgccaaccaagctcccgacaccaagttcctgccagcgaggcttccgccaccgcccagcagactgccgccaacgagtgccaggtgtgtggatcttccttcgccacctccagtggactccgccgccacatggccaggcttcatcgagctgcctctgcggatcctgagggtgctgcgccggcttccatcacagagattttcgactaccccttgccttcccggtggaaatgctcggcatgctcggagaactttttcaaccagcagaccctcaagcgacaccagaccaggcatcatccagctaccaccttcgcgtatgcctttcggtgttcgtcatgccggtccgagttcgactcagcacggagggctgcgaaccattggcaggtccacaagaaggagcgatctcaactctctggcaccgagccccaggcctcttcccaagccagagttagcatggctcattctcctccacctctgcccaacacttcttgggcggagctcgcctcgaatcctgccgagataccttccttcgtctgggagtctcctcccaagaaccgcccctcggttgaggagttcggttcgtctctgccaactgatgttacgatgatgtctcaaagtcctccaccgcaggtacagtcgtctcctgtccctgctctgactcctctttcacccgctgccactgcctccagttctcctccaggggctgcaaggcagctgacccctcctacacagactaacaccccagtcacccagagggctcgcctgcaacctgaagcagacgtcgtacctgaactccctccttcagtcaccgagcaccctgtgtctgacgctcaacactgggttgatgctgtatcctctgcatcagattggtctgagtttgaagcagtatgtgatcaatttgtcatccacgctgttgctgtttcccgtcccaatcttgctcgaccccagcagcaagataggcagagatctggtgaccaccctcctagacagcaaagaggtcagcatcgaccaaccttcgatgtccgtgaggcaagtagaatccagaagctctatcgtaccagcaagaaaagagccatcagacacatactgaaagagaaatcaccttccttctctggttccgagtcagacgtcttagacttcttccgcgaggtgtattctgctaaagaagttgacgaggaagcagttggtaaactagcatcctcgctcttcgatgtccctcaaggtgatgactctgcgacatctctgtctctgcccacgtcagcgaaggagatcggagcaaggctgtcaaggatgacaaactctgcccccgggaaggatcgcttggagtacagacacattcgacgtgcggacgggtccttcagcatctctgaggccatctttaacaaatgcctggctgaaggtcggatcccagctccttggaagacagcatctaccatcctacttcacaaggctggccccacggatgatcccgccaacttccgcccaatcgccttacagtcatgtctctacaagctttttatggctgtacttgcggaccggctgaccaagtgggcctgtgagaaccagtacctcagccccgagcagaagtccgctcgcccctgcgaggggtgcttcgagcactccttccttctctcagctgccctgaaggactgcaggagaaaccagaagaccatctgcatcggttggttggaccttaggaatgcatttggaagcattcctcatcctgtcatcaagatcgtcctgtccagtctgggtgtccctgattcgcttgttaccctcctcatggatgcctacaatggtgcgtcaacctcgttcacgctgaccgggggccagaccgacaccgtacccatcagatcaggggtgaagcaaggctgcccgatgtccccaatcctcttcaacctggccatcgaacttatcatcagggcagtcaagaagaatgcatcagacaaccatctcggagtgactgtccagggcaagaacctctccatcctggcctatgctgatgacctagtgctgctcagccgagacactgaaggcctccaatccctccttcaagttgctggctcttctgcatctacccttcagatgcagtttaagccccagaagtgtgcaacactcacccttgactgcaagcgtggtaccaatgttaggcagtctgctcaccatatccaaggggctgccatcccatcgcttactgaagaggagcgttaccgctaccttggggtccccattggactcccaaggctcacaagtctacaggagagctctaggaagctgtcgtcagacatcgagaccatttcatcctcccttctagcgccttggcagaaactggatgcaatcaagacctttgtgatacccatccttcagtataccttgcgggccacagaatacctcaagtccgacttgaaacccctacgagcagccattatcaagcacgtgaagaagatctgccatcttccggtaagatcatccaacgccttcgtcttcgcgtcccgaccctccggtggtttggcttttgttgacccaggagtggatgccgacatccttgtcgtaacccaagccgtccgtaccctggcatcggatgatgacacggtgagagccgttgctctaggacagctgacctcagtggtccacaggacggtccattctgcaccatcagatgactgcatcgacaagttcttgtccggaagcagtgagggccctctggcaaactcagggaacagtggccaggcatcatctctttggtcacgtacaagggctgcatcccgtcgcctgaagataaggatcgtcggagcctcgagcggcgacatcaaggtcgagagtggaggccgtgccatcccctccaagaaagtgactgcaggtctccgctccgaccatcacaacgagatgtcagagaagctgcggtcccttccagaccagggcaaggtagccagggcactctccttggatagtttcgccaacgcaacatcatggctgacatccgggagtttcatccgattttgcgactggaggttcatccaccgtgctcgcctaaactgtctacctaccaacgctgctgtccggcggtggaaacagaacgccaacaccaagtgccgaaggtgtgatcaccagttggagacgttgccccacattattaacaactgccgtcccaacatggtaccgatccgccggaggcacaactccatccaagaacgcctggtgaaggcgattcactacggtgacatctaccaggaccagcatgtccccggcgacccgaacccaagggagcgacccgacatcacagtggttgagggtaacaaggtgaccattgtcgacatcaccatcccattcgacaatggtccggatgccctctccacggctgccaacgccaaagtcatgaaatatgacacactgcgacaagagctggccagccgtggtatggatgtcgaggtccacgcttttgtaatcggctcccttgggtcgtggcacggggacaacgagcgtgttctgggacgtctaggtatctctcgccgatacagaacactgatgaggcgcctgtgctgcatagatgcgatcaaaggcagccgggatatctatatcgaacatgttaccggtcaccggcagtattgaatagcatttatattgtgttccaaacaacatactcattattatatctaaacatttttttttctgttcctgacaatctacgtaaagtctgctaaccaactggcatgatgaaataagataaaatccccttacacattaatttcttgtcacatcataatgctttgtcaaagcaatgtcctacataatatctcgatgtcaccccaattaattttacatccttcggtaacctttataccgttggatcaacatatatgatttgtaaaactgttatttctgagttttttctatgctaataaa

SEQ ID NO: 1064 - DNA, 3968 bp, Nasonia vitripennis
  modified_base (805)..(805): a, c, t, g, unknown or other
  modified_base (914)..(914): a, c, t, g, unknown or other
  modified_base (1216)..(1216): a, c, t, g, unknown or other
ccattccttcgtacgggttttcgtgccggcatagccgggtgggagactcgcgcgggggaggtcatatctcaccaccatcctcgagctttttgctgcacctgatccgggmtaactggccgagaagttaaatgtattactgttaatgtactcatggagcaacaaccacacaccaaagcgatccgggagggggacttcatcgtgatactcctcccgcaaagtgacgacgagacactttgctgtccactctgcgtgggacgcggacggtactccggcaagacgcgggttgagtgtctcaatagacatgtcaaagaggtgcacccagacctaaccaccacctttaggtgctgggggtgcgggttcgcggctcccggggataagaaatatccccggaagatcgtgacccagcactgcgccacctgcgtccccgaggtttcgtccgcgccctcgggcagagtggacggagagaggagagttaacacccgccgtcggttgggtattgccgcggcaaccgaggccagtcccgtgagacgtactcgtcgtaacggcctggcctcacctccagtcgagcagaacatcagccaaagcgcggctcctccggaacccgcaagggtgccacaacatccggagatagttgcgctgggagagtcagcggatgacgaagtatttcgatctccggtgaactctcccccaagagactggagggctgcggcgccccaacaggcggcttcctcctctcctcsggcggtgcccggtatcactgctgcaaccccgtccaacaccaccaggacagggaatggctcggcanactccatcctagccgagcacccgatacctgcacctccgccaaccaacaccacggaggcgaatggtcgtgccgacataccccgttctgggcgggctccgccgcccggtcnacaagccgcccgtagaagggctcccacgacagaacaacgtcgcattgtgggactcctcgaggcggccactggtcgggagcagcttgaggaggcaacgactcaagctatgctattcctggccagattgaccgggcggcggcctgaaccccggaacgccattcggccgggamcgcggcaacgtcatccagctcagggggatgtccaagcgcaggcgcctgatcggattcasgaggccaagaaactccagcgtctctaccgaacatccaagaagcgggcagtmcagaagattttggcaggtcctnatatgaactgccaaatcgacaagaataccatcacagcccactttgtggagctggctgcccgcagagacggtggagaggattggcccgatgtcttcgatcgggaagagcccacggcggcgagcggcgaggccctttgtacccctatcacaagggaggaagtgtttcgacggctcaaggggaggaacaacacctcacctgggccggacggaatcacctacagggacctcgccaaggccsatccaggggcccatgtgctcgccgccctctataacascatctggcgcattgaggcgacgcctgccttgtggggggtgtccaacacmaccctkatatacaagaaaggcgacgccatggacatctccaactggagaccgatctccttgggagatacggtccccaagctatttgccgcgatcctggccgatagaatcaaaaggtgggccgtggccaacgggcgctacagtgcctcccagaagggcttcttggagttcgagggatgctatgaacataacttcgtgctccaggaggccattcgggaggcaaaaggcgggagaaaggagttggtggtggcctggctggacttagccagtgcctttacatccgtgccccactcctctatcctgcaggcgctcgagggacatggcctaccaagcaaagcgagaaacattatctcctcgctctacacaggcatgaccacccgcttccacacggcggagggacccaccgaccctattctcatccagtcgggggtcagacagggttgcccattaagccccgacgtgttcaaccttaccctggaagttgtcctacgggaaatacaacggacgggggagggctacacgatcgagggcaggcgtatttcccatctcgcctacgccgatgatgtcgcgatcctggctgactccccggctggaatgaggaggctgctttttgcagcagaacggggagctcgggcggtcggcctcaccttcaacccagcgaagtgcgctacactgcacatagcgggacgaggkgaggaggcagttagaccgactgagttctccgttcaagggacacctgtccgtgcccttgcttccggggaggcctacgaacatcttggcatccccacaggctaccaagtcaggcagaccccaatcaacaccttgcgggatctccttgctgacatcggctccatcgaccggtccttactggcgscctggcagaagctggatgcagtgggaaccttcctactgccccggcttgatttcaccatgcagggcgcccatatcgacaagggcttcttgaccgaggcggacaagatcatcaaaaaagctgcaaaatcttggctaagccttcctcagcgagcgagcgcggagctcgtgtttctacctccctcgcaagggggagggggtttgctcacggtcgctcacagctataaaatgctgtactcgagcgatgtcaccgtgagcaccatagcgggatccacactgaggaggaccgtttcggagaggcttaaaaagcgggcgtctaacatcgatatcgcccgcttcctctccggagatcttgatctgccccggtcgacgagcccgtcgacattctggaccaaggttcggagcgcggccctgagaattaagaccaaactcgggctgcgctggagctggtgtcaggggggggaagtactcctgatggcctgtggggatccacgtgcccccggaacaagagtctcgccgcagacaaaacatcttgtcaccacgagtctgcggcgctgcctgaatcggcactatgcggagagtctccttgccaaaaaagatcaaggcaaggtctttgaggttacccggaggagcggacaatccaaccacttcctccggagtggcagcttcactcgcttctgcgactggcgctttatccaccgcgcccgtctcgacgttctccccctcaatgctgccaaacggtggcaacgagggatggacaagagatgtcgcagatgcgggtcagacctggagactctcccgcatgtgctgagtcactgcggcccgcactcggcggcgagacaaaagaggcacaacaacatccaggacaggttggtgaaggcagcctcgagatgtccggggaccattagtgtcaaccagaccgttgtgggcgtccgcggccccgacgcggcattaagacckgacattgtcgttcgcgacgatgtcaaccgccgcgtcaccatcgtcgatgtggccgtgccgttcgaaaaccgcctcgaggcgttcgacggcgttcgkgaggccaagattgccaaatatacacctttggccaggcaactcacggacagcggttacaccgtaacggtggaggcctttgtagtgggcgccctcggcgcgtgggacccgcgaaatgaacgggtcctgagcctcctcagcattagtcgttattatgcgatactgatgaggaggctcatggttagtgacacaattcgctggtcccgggacatctacgtggaacatgtgtcgggcattcggcagtaccgggaatagtggggccataacacctaggccccacagtgtggcgatgtccatgtgtgtcgtccttacttatttatttatttgtcctgtcgagctgtttaatctattcatatgtatgtgttgtgtgtgtcgtccctcgtagcagttttattccgtccaaccagaggtcgaccaatattaaaataagcatggcttgaagcaggccaagcgccgtgttctaaccccgttttaggggaagttacttaacctaaaaatacaacttttcc

SEQ ID NO: 1065 - DNA, 5717 bp, Phytophthora capsici
  modified_base (169)..(169): a, c, t, g, unknown or other
  modified_base (956)..(956): a, c, t, g, unknown or other
gcccgccggtggagtagccatgttggccaccaccgcccaagtctccgccgcagctgcgactgctgctgctcatcgagtcgcagtagtcgcagctgcacaagcaccacctcctgccggacgcgccgccgtggagcaccacgcgcgcgctgagccgtaccaagaccaaggnttccaggctcgcgcgcgcgtggmgctcccagccagcgacgcgttcagcagcagggtcggctgcggcagctcgacgctgcacggggacggcagcgacggcaggcaccaagaccacgacgaccaagccgtcgctgccgtccccatggacgtcgaccaaggtgctcggtggccgacagcggatcamcacccgctgtcgccgccaccggagctccgagtcggcggcaagcgccgccgcctgaacgacggcgacgacgaagacatccgcgagctggccgagcttctgctgcccgacgaggaggaggccgacgaccacaaaccagcgcccaggttacccgcgaccagcgctcatccggcctccgtcctcgctgtgtacgcgcacaacgcgcagcgcttcaactgcacgttgtgcgtgtacacggctgccagcttcgctgctcttacgcgacacagggactctcggcaccggcgcgtgaccttcctggacaggttctcggcgggttgcgcgtgcggcaaaccttttgcctcgaggctggccgcagcaagacacgcacaaacgtgcgccagcctcagcaccacactggtcgcggtttcgacgacaggaggagcatcaagccacactgtcgtcggagccaacaccaccgtcgccacggcggtcaccgccgaaccccccctgctccaccatcaagcctcggaactcactgtgcccccccccacgtgtgagttcccccgacgtcgatgtgcagctgcacagtccgccacaggaagatcagcacgaggacgccacccancacccggagagcacgcaacaccaacctcctgaggcaacccgctggggttcgccgctcgcgcccacgctcgttgcctccaggattgctcagcgactcggcgagctggaacctccacgctggggcccaccattaccccgcgcgatggttgtttcgcgaattacagcacggcttgaagctacacctgctcctcgatgggatccgccactcccacgccgcgtcatcgcctcccgcattgccgaccggcttgtacctgcgacggcaccgtgtcgctcggccctgaacgctgcattcccttctccatcgcgagacacggtgacggaatcgttcacccaggaggacaggcaactggaacccctgacgcggcacgtggacgaagagacgaaggacagcgagctgccgggcagggcgccgactgtactcgacgaggagtccaaggacaatgacgccactgccggtgagtggctcctccggttcgacggagcttgtcgagcgaacccaggcccaggcggagcaggtgccgtgctattcaaccctagcggtgcagcgtcatggacctgctcgcactttatgccgggcgccacggagacaaacaacaccgccgagtacacggcattcctcctaggcgccagagctgctgcagatcacggtgcgacgctacttcgcgtccagggggacagccagctcgtactcaggcaggtcaagggcatttacggtgcgaagagcacccgtctacggagactacgcgacgctgttcgtgccgaactggctcgggtggggcaattctccctccaccacatcgacaggcaggacaatgcgcacgcagaccgccttgcgaacagagcgctcgacatgaagagcacactagtggaatgcgcaacgcaccccggccggaacgcctgcaccacgacactgaccaccagtgctgccgctgaatcaccggcatcacccccgccggtgggagctcgagacacgccgatggccgatgccggcgaagagcgcctcgcagacgttgacgatggtgaagtttacgcggcgatgcggcttggcccaggcgaagttcctgaacgacggccacgactccgcctccgccagctgagcgacgaggaactggaagcagcgagcgagatggtggagcgactgggcgccgccttatcggccaagatcacagacgcggaagactgggcgagtgcggagggctacatcacggccctaccgtacatgctgtacgacaagcttcagtcgtactcacaggcaccgcgtggaccccaacaaccggtcttgacccggtccccgcgcggcgacgatcgcccagcttcctcggagcccaacgcatcatccacgactggaggggtggcatcggagcaccaaccgcggcgccgccgacgacgaggacgacgcaagggccgacgacagcgccgcaacccgcgccgatcgggacgcgagggagctacaggtgggcatcaacaacacaagaaacacaaaccacgcccaccccgcgagacgcagcatcatcgggaacaccgtctcgacgaggctctcgatgagctccacgccctcgagcgtaccgatcctcacaaccggccagcaattgccaaggcccgccgccgcgtcggtcgcatccggtctgccatcaaccagcagctactccgccacaagttcgacacggacgagaaggcctgtgtcgacggcatcctgtctacagcccgcgccgaacgcgctgcacgagcagcaacgccgtcgccaccagcatcaggagcgcccaccacgacagtctcggcgcccggtgccatcgtgaccaacgatgatggcacgtgccccatcccgagtgacaagctttggcgacacttcgacgccgtgaacacaccgcgccttgacttcgatgcggaggcacccgggagtgcggccttccgagcggcgatggaccacctgcccgcggcgacacggttgctggacctgctcaaagaggcgccgagcacggacgagatcgagacgcaactccagcacgtgaaggcctcctccagccccggcctcgacggcgtcggctacgacgtgtacaagcgcttcacgatacagttgctgcctgtgctgcgggcggcgttccggtgctgctggctgtataagaaggttcctcagagctggaagctcggcgtggtgcgcttgctgcacaagaagggcccgcgtgaggaccctgcgaactggagacccatctgtctccagcaagccatctacaaactatacacgggcatcctcgcgcggcgactaacccggtggatggacgcgaatgaccgccacgcacccggtcagaagggattccgagcggtgaacggctgcggggaacacaacttcctcgcagctacgctcatcgacaacgcccgccgcaagcatcggccactgtacgaagtctggtacgacttccgtaacgcgttcggcagcgtgccgttcgcgttgctgtgggattcgctacagcgcctcggtgtcccgcccgactacgtggacatgtgcaagggactctacaaccaagcctcgttcgtcgtcgggaacgcagtggatggcagcacagcgccggtagagcagcgcgtcggcgtttttcaaggctgtccgctcagcccccagctctttaacgccgccatcagcccactgctctatgcgctgcgccggctaccagataccggcgtgcagctctccagtgttgaccgccctggtgcctcagcgtacgccgacgaccttaagattttcagcggcaccaaggcgggcatcacgcagcaacacgagctggtggcgacgttcctgcggtggaccgggatgcaggccaaccctgccaagtgcaggtccatgggcgtgcggcgcaacaccaacggmgccgtcgaggcagacaacgtccacctcgagctcgacgatacgccgatcccctccatgacacacatgcaatcctacacgtacctggggatcggcgacggcttcgatcacgtgcgccgccgcgtcgagctcgctcccaagctgaagactctcaagcacgacgtgacggcgctcgtggagtccggccttgcgccatggcaggtggtgaaggccgtgaaggtgtacctctaccctcgggtagagtacgccctccggcacctccgacccgatgatcagcacctggagagcttcgacctccaccttcgccgcggcctccgccacctgcttcgccttcccaagaacgccacgaacgaattcttctacgcgccggtgtcgcgcggtggtttggggctgctgccgctggtggaactgcacgcagcactgcaaatcgcgcacggatggcagacgctccactcacccgacccagccatccgtcgcgtcgcgcgcgagcagctctaccagattgccgacgcgcggcaccggctcgacaaggaccactggccacaccggagagaggaactttgcgagctcctcctcaacggggagctcgggacgtcggcccacgcaccgcccaagcgacgcaacggtgacatcggctctctgtgggtcgacgtccgcaagaacctcaagacgtttggactgaaggtggccacagcgccggccaaccaggagaccggtgtaccagcccagccgctgcagctccgcgtgcctcaccacgccgagtggctggaccacggcaacgtgctgaggcacgtgaagctacacatcaagaacctccactggcaaacctggtgcgccctaagtgaccaagggaagaccgcacgggtgcacggcggtgttggcagcgcattcctgacccgacctcgcggcatgtgggaaagcgactaccgcttcgcggtggccgctcgcctcaacgtggtcgacaccgtcaacacactgtcgcgccggcgactccgcgcccacgaccggtgtcggtacccggcctgcaggtggaaggagactctggcacacgtcctcaaccactgcccgggtaccatggacgcggtacgtggccggcacgatgacgcgctcaaggaaatcgaacacacgctccgcgcgtcgtcgggcgaccgccgcgagctgcgtgttaaccaaacggtgcctggcctgcccgggccacccctgcgccccgacatccaggtctacaaccatgacaaacgcacggtcgcagttgtagacctggctgtggcgttcgatgagcagccgagtgaggacccagagagctcggggttggccaaggcagtccagatcaagaaagccaagtacgcgggcatcaaggagcatctcgagaaccaggggtggaaggttcatctctcggccatcgtgtacggctcgcttggctcggtggcggccagcaaccacaaggtgtacactgaacaccttgggttgctcaagcgcgatgcaaagcggctggaccggcagctctcgtcggcatgcatccagtccagccgccgcatctggaatttccactgcgccaagcaccgagcacgccagcacgagcaccaagcaccaccaagccaagcgacacggggcaggagggtgacggaaaccggggggaatccgtcgcgcaccgaccgccgctagacggcacagttctggcccacgtaggccgaaagggccccacccatgtagggaaccgccctcgggaaatccattccggtgttcgactgaagagatgctccttcgccttgacggaggtacatctcgacagtcgaacttcaactcgcaacatatccgatacagttacaaaccacagttagatatcagataggaaccttcctttaggaagctaacgggtacactggatggtaaatacacatacatttc

SEQ ID NO: 1066 - DNA, 6438 bp, Phytophthora infestans
agctcggcctcgcggctgccttcccaggcgccgccgacttcgcgctctggcgcggcccacacgccgccgccgagcctccaagcgcgcccgttggctttcgcagacgcagggctcgcggcgacggccctcgccagcccccaagaccccccctacgatgtggcaccacccggcagggcggccggcaggctgcccgactcggtatcgccgggtgctacactctcagccgccacagctcgggccttggcggtccgccattggcccttggagctcgacagcgacagcagcgacgacgaggacgctcaagacccccacgccgccgccccagaacccccagaagacgtcgcgagtgtgcttgccccacccggcagggcaggcagcatgctcgccgacccagcagcgctggcagccggtctggctcgcgctccgccgcccccatcggcaccccaggacccaagccccgccttccctgctggccccgccggccagaaccctcgcgccgccgccccagcccgtgttgaagtccacacagtcgtggcaccacccggcagggcgggcggcatgctgcccgacccggggttggttgaagaacctatccaagcgacgtacgcgcacgacgctgcccagttcgagtgtgcgttgtgcccgtacgtcgctgagagcatggcagtgctcgttcagcaccgacggtcggctcaccgcggcacccgcttcaaggacatcttcaccagcgggtgccagtgcagcctagtgttttacgcgcgcattgttgccgccagccatgcagtggcctgtgccaggcgcaaccagcgagccgtgccaccagctccgacccctgttgcccccacgcggcccgaggctaccccacaacctactgggtacctcgccgcggcgatgactgccgctgcggcagccgcatcaagcgacaccgtagtggcagccgccaccaacatgcagagcgccgtgccagccgccgccaagaccactgggcttcagctcgtcccccccgagctggagcctgcccttccgcagcgtgcttcttgccatgcaggcaaacgccgtcggctcaatgccgacgaggcggtgacaccgtgtacgcctacggcgcgggtgtcgccgcaaacagaagtggcgatggcgcctcacgacgcaccccaggacgacaccgtcttacagcgtgaggccgccgagccacagccagacccagcagcaacgccgggtgcccaagtgcagcgagtcgaagacacaactgcggcgcaggatgacactgtgcagcaggaccacgacgccgacactgcccaggtctcgccgccccggcgcacacccacacgctggggaccaagaccaagctcaactcaagagcctagccccatgacaggcgagccggctgccaccctggcagcgcgaagaccactgactcctgccgcaacgggcactcgtgccacgcggtgggggccatgtcaccgcgcgatcggggccgcagccatcgcacgacttgtcacgggcctttcaacggagccagcgcagcctcagcgacggcagccaccgccaccacaagaacctccatcgcaaccagagccgctagcagcagcagcaacagccgcagcagacatagcagcaacagttgcagcagacattgcggcagcggcagcgaacgcagcaatggacgtggatggtggaccggcagccgacgagacatggctgttgcgctttgacggcgcatgccgacggaacccaggacctggtggagcaggtgccgcactctttgcgcccagcggtgccgtggtgtggacgtgctcgcactacatgccaagccgctccgaaacgaacaacaccgccgagtacacggcgttactgctcggcgtacagagcgcagtccaccacggtgcctcgcacctggaagtcgagggcgacagcagcctggtaatcgctcaggtaaagggcaccttcgcatgcaggaatgcgcggctccgccaactccgcaaccgagtgcgtcacgcgctccgctccgtggacacgcacaaactccggcacatcgaccgccaggccaacgcgcatgcagatcgccttgccaaccgcgcgctagaccagcggaggaccagcagcgagtgcgggacgcatggctcgtgcatggactcctgcctcgccgtacccacggccctggcggcgcaagaaacgccaccggcagcaccacccagcaccagtgccactccagccgaaggtaatgccatggacgacatcgcagccgagattgctgcgcgtgacgagggcgagaccttcccagtcctgccaattggcccaggctcagccccagaacggcaaccccgactccgtctgcgccaacttagcgatgaagagcgcgacgcagcggcagatgccctgcaggagctcgccgataccatggcgagtaagatcgaggatgctgacagctggacctccggcgaaggatacatcagctccatccccgagcgtatccgagaggtactgcagccatacgctacggccccgccgcagccgggacgctctcgccggcaacaacgccgtcgaccaccacgggtgacgcgcaaccagcgcgaacatcgactcgacgaagctttggacgacatggcagccacacagcaagcgaccccgcgagaccagcgggctgtgcgccgtgcgcggcgacgtgtgggccgggtgcgagcctcaatggcacaacaggagctgcgccacgagtttgccaaggacgagtctaagtgtgtggccaagatcctgaagacagcgtcgacagagacggcagcggaggacgagcacccggagacgtgccccattgatgcagctacgctccacgcccatttcacgggagtcaacgcgccaaggacggacttcgactacgatgccaccagcggccgggagtttcgagcggcgatgagcgaccttccgccagccaccgtggagattgatgcgttcgacgcggagctgacgatcgacgaggtggaggaccagctcacacgcgcggccaagacctcaagccccggccacgacggcatcgactacggcatctacagccgcttcgccgcgcagctcgttccgctcctccacgcggtgttccagttttgctggagacaccgtcgtgtgccaagactgtggaaggtgggcatcgtacgcctcatccacaagaagggcgacccaaggcagccgactaactggaggccgatctgccttcagcccacgatctacaagctctacagcgggctgctggcgcatcggctctcacgctggctggaaggtaacgaccgcctgccgatggcccagaaggggttcagggccttcaacgggtgccacgagcacaatttcatggctaccacgttgctggaccagacccgccggcagcaccgaaagctgtaccaagtgtggtacgaccttcgcaacgccttcggctcgcttcctcagcagctcatgtggcgcgtgcttcgccaccttggcgtcgactcaggcttcatcgaccgctgcagggatatctacagggactcggccttcgtggtggcgaacgcggcggacggtgcgacggacccggtgcgccaagaggtgggcgtataccaaggctgcccactcagcccgctcctgttcgtcgcggcgctggtgcctctcgtgcgccgtctcgagaaactcgacggcgttggtgtgccactggcggacggtgtgcggccctgcaccacggcctacgccgatgacctcaaggtgttcagcgacagcgccgccggcatccgcaagtgccacgacacagtggctggcttcctcgcgtggacagggctgcgcgctaaccctggcaagtgtgccagcctcgcagtgacgacgaacgcccggggcaacccgactagagacagcagcatgcgtctcgaggtccacgacgccgccatcaccacgctcagcctccacgaaagctaccgctacctgggcgtgggtgatggatatgaccacgtgcgccatcgtctccagctcgagccaaaactcaagcagctcaagcgggaggcggtggcgctgctgacgtcgggtttggcaccgtggcaggtggtgcgcgcgctcaaggtgtacgtctaccccaaggtggagtacgcgctgcgccacctgcgcccgctgcagtcgcaactgcaggcgttcgaccgtgtcgtctccaagggcttgcgacacctgctgagcctgcctcgctcagccaccagcgaggtgctgtacgccccgacgtccagcggaggcctgggcctgcagccgctcgtggagctgcaccgcgccctacagctcgcccacgcgtggcagatgctgcattccaaggacccagccatccaagcagtggcaagagcgcaggcttgccaggtggtgcgcaagcgctaccgcctgcaagaagaccattggcgcgggcgcgatgacgagctcgtgcgcagcttcctgaactccgagctcgccgcctcgccacacgctgaggtcctccgtcgcaacggtgacattgcctcgctgtggtccgacgtgcagcggtggctgcgcatctaccacctgcggttcgagcactgcgacgagacagaggcccatggcccgctcagcttccgcgtgccgcaccacaacaagtggcttacgcacaagactgtgctgcggcacgtgaagctacacctgaagatccgacaccagacccgatggaagggcatggtggaccagggcaagacggtgcgcgtgcacggtggggtgggcgccaagttcatgacgaccggagcgggcctgtcggacgacgactaccgcttcggggtgaagggccgcctcaaccaagtcgacacgaactcggtgctcaagcgcaaacgactgcgggcacacacgacctgcagggacccaacctgctcctcggctgagacgctggcacatgtactcaaccactgcgagtccaacatggacgccattcgccagcgtcacgacgacgccctggagcagattgggtctaagatccgcggagcgctcgaccgcgccaagtctcccacagagctgcgcctgaaccagactgtacccgagtacacaggcgcagctctacgcccagacattgtgcttagaaacgtggccgccaagacgatggtgatcgccgacttggcggtcacgttcgaagaccaagcggctcgcgctcgtcactcctcgctgcagctcagccacgaccacaagactctcaagtaccaaccaatcgtggcggagctgcagcacaagggatggcgagtgcagactgctgccatagtgtacggcacgctgggctcggtgcagcccagcaacttcaaggcctacactgagaagttcaagcttcacaagcgcgaggctaggcagctggatctccagctgtctagccactgcattcgcgccagccaccgcatctggggctggcactgccgacagcaccgcgatcggcaacgaagcggcactgcctcgcgagcgtcgcgtgggtctgggggggccccgcggcgcacatcgcaggcaccggcacggcgataagctggtcatcatgaccgacagggcactacccaggtagggaaccgcccttaaaaaacccaggaagacacaaacaccctccacttagtgacatacatattttagcctagatttcagttacggagaggttactaactggtaaatacgaacacatattctgttctaatcagtgtgaaaactggttttcgccttttggcggactttttcactcgcatttttgggcaatcgtctgcggctagcttgctagcggcggacgagcggtctccgggggcgttcacctttcccccgcgaggccaactacaccgatcttctctacacttttctaattcgcctccgtcttcggtcttcggttgtcgggcttttttctttttgaccaatcagagcgcgccatgcgcctcttctggccaatcagagaccgggccctgtcctcggacagcgaggcctccacggccagccaatcgagtctcggcagcgacgcgtctttctatagcgcagctgacgaggccgatctggcggcccccgattggtccgactttcggccaatcagcgacgacgagggggcaggggtttacacttttgcccccgtttcgacttcaacttcaggccaaaatggcgatttggaccctccacgcgccgtgccactgctcggcaccggcggcgattcagcgggtgcaacttcgggcacgtgtgcaacacatgcagcgcccattgcacgccaagcggcatcgcgggacgacgcctcggccgcccaagcgcagccccgcccttccagcacgacctcgcgccgtttggcggatcgccatcaagacgtgcgagagccaggcggggtcgggcaaaatatacttactctaagtatgcccgaatccctgccctctcaggctgaacgcggccccatacttgatctaagtatgggaggatccctggcctctcaggctgtacgcgagaccc

SEQ ID NO: 1067 - DNA, 5135 bp, Patiria miniata
ctgatgtggataccttggaattactcaaccgtgtcggagtcttttgtcttttgcgcccaacacctcatggataccatgcttgtcgctggagcgacgttacaagcgtgagggcgccctccatgccggacagctggtctgtgccatgtgcttgaagtcgttctcctcgacttcgggcttgcggcggcacatggcccggctgcaccggcagccttctcccgacgcctccacgccctcgactatgacggaagtgttcccgtacccccttccgaaggtgtggccgtgcgtggtgtgccgcgagaacttctatcacaatcaaaccttgaagcgtcaccagaagaattttcaccccaatgttgacctcaccaccgtctaccagtgctcagtgtgcgggcaggagtttgtcaccggcaggaaagcatccttccatttcaaagttcatcggcggatgtcagccagcgccatccctaccccgtctgcaatgccctcctcaccgatggatttgatccgaggcctcgtcggggaacccctgcctcctagccctgcccgtacaccgccaccacttgcccgatacatctccccagcgccccggtcttctttttcaccaccctggaatccctccccaccgccccggtcgcccaccccactgccacggccactcactccaccgccacgatcaccgagcccgccgccccggtcgccaacaccacctcccccggtcaccctcaccaccgccccggtcaccgagcccgccgtcccggtcgccctcaccaccgcccaggtcaccgagccctccgccccggccgtccacaccgccgccccggtcaccctctccaacgccccggtcaccgagcccgccaccccggccaccgatcctgccaccccggtcaccagactccactcaccggtcactcacatctcatgctcgatctccttcacggccagccacgccccctattcctgtgcagccccgacatctccgtccgtctacgcctgctcacccaggcgtagacaatgcagttccaccatcgcagcagtctgcaattgacgtgtggctggccgagctgtcacgctcggctgacttcgagtcttttgaggatgtgtgtgatcggtttgtggagtttgccgccgctgagggtcgaaacaacggacgcccagcccgcccagcgcaccaaccgccccgtgaccgcgggaaccagggacctcgcccccaacgtccccctcgtccccaccgccccgggcttggcccggagtttgatgcacaggaggccagtcgtctgcaaaagctgtatcggaccagcaagaagcgcgccatcaggactatcttgaccggctctgatgtccgatacagcggctaccgaggtcctcactagtggatttctttcacttgaagtattttccgctcgtgaggtcgacaccgacaccattgccacggataccagcctcctgtttccgaactccgcccaagcccgtgagtccggccaagacctgcttcgcccagtcacccagcgtgaagtctccctccgtcttggccggatgtccaactccgcaccagggaaggaccggttggagtaccgtcacatccgccaggttgatggcgcattccgcgtcaccctggaaatcttcaaccggtgcctgcgtgaaagccgggtcccatcctcctggaagacagcgaccaccgtgctgatccacaagaagggggatgccaccgacccggccaacttccgccccatcgccctccagtcctgcctctacaagctgttgatggcgatcttgtccgaccgtgtcaccacatgggccctggacaacgatctcatcagcagctcgcagaagagcgcccgccccggtgaaggttgctacgaacacacatttcttctctccaccgtcgtgaaggatgcccggcgtaaccagaaaaacatgtacgccgcctggctggatttacaaaatgcattcggcagcatcccccacgacgcaatgttcaccgtgttaacctccatcggggccccggagggcctggtctccctggtgcgcgatgtgtacactgacgcctccaccgacttcgtcacacccaccggccgcactgctgcagtcccgattcactcaggcgtgaagcagggctgcccgatctctccagtgcttttcaacctgacgctggaacttattatccgagcagtgaatgcttcagcgactcgggaccgcagtgcgccggtggtccatggccaggccgtccccatacttgcgtatgctgacgacctggtcatactcagccgatccagtgacggcctgcagagcctcctgacaacagcatccatcatggccaccaagatccagctgaagttcaagcccgccaagtgcgcttccctctccctcgagtgccgacgggggaccaaggtacgccctcttgagttcaacgtgcaggacaagatcatccccgcccttacagaggagcagcactaccggtaccttggtgtccccatcggcctctaccgcaccgacgacagcctggagaccttggtggccaagatgactgatgacatccagcggattgactcctcactcctcgctccctggcagaaactggatgccatccggaccttcgtacagccctgcctagcctacaccctgcgggcaggggactgtgcgaagaaacacctcaagagactgcggggacagctggtgaagacagcccgcaaagtatgcaacctgccgactcgggccaccacaaactacatctttgctgatcgtagggcgggtggcttgggtttcatcgacccaaacgtcgatgccgatattcaaatcatcacgcaggccgtacgcatgctgtcttcacccgacgacatcaccagagccatcgccaccggccagctgtcttccgtggtccaccgcaccatccaccgagcaccgacacaggaggagacggacgagttcttgtcagcatcaatggagggggactttgccaacagtgggaacagcggccaggcctcttcattgtggtccagagcacgtgcggcggcccggcgactgaaagttaccatcagcggcagcctttccggctcagtgatcaccaagtcaacagagaaccgggaaatggctgccaagtccatcactaccgccctgcgtgctcagtcccgcgcccactacacccaccggctgctgtccctgcccgaccaggggaaagttggccagtccctcaaccaagaccaatacatgaactcgtcctcgtggatgtcctccggtagctacatcctgttctgtgactggagattcatccatcgggcccgtctcaacacccttccgaccaacgcaacggcgcagcgatggaaacccaacaccagtcccgcctgtcgccgttgccagcacccgcaagagaccctgccccacatcctcaaccactgcccgcccaacatggtacccatccgccgcagacacaacctcgtccagcaacgcatcgtgtctgcggtacgccacgggcgggtgttcgtcgaccagcacgtccctgaggatcccaacccccgggagcgcccggacatcacggtcgttgagggcgacaaagtcaccatcatcgatgtatgttgccccttcgacaacggccgtgatgccctgatgaccgccgcagccgccaaggagaccaagtatgccgacctgaagcaggcgctggtggctgcggggaaagacgtcgaggtgttcggattcgccgttggatcgctaggctcctggttacctagcaacgagcgggcacttcgacgtctcggcatcgccaagcgcttccggactctgatgcgcaaactcctgcgcatcgacgccatcaagggatcccgggacgtgtacatcgagcacatgtgtggccatcgccaatacaccgattagcgaacactaatatcctgccmtagacgtgattgctaatccgcaaaccaaccggatctacagcctgaacactgaactttaatcttcacccatgtcacatctggacactaggtttttgctctgtttgtgttttcctgcctttwcmttggawctttcgcmctggaatttatttgtcgcttggattattttttttctcacaatttggatctattttcgtttgttcacttcgaactctagctgccctttcttcggacactgaactttaatcttcgccatggctgtcagtcgccggttcacttgctgcggtgggatcctgttgtgataatccccgtgcattgcccatggatttatttccgccttagttgttcctaaccttggatttattgctgtgggtgatgcccgggttttgtttacatcgggatcccgctgcggctcggtgttccatgcgactggcagcccctttgtttactctsgactctattcattgttgtatttcttccacactggccagtgatcacactgctgtgtttcccgggaagatatcctctgcggttttcacgctctgggtgtctccccgggcaacgcactggttgcttgctgcgccatcacccttttcgtttatattcattttcagtctgccgttatcttggccagcgctcattcttttgtgatggccgtggactgaccctctgcggttttctgcggtcascactctcggtgaatgctgtgccaccatttttcatttgtttactttttcagctacaattatcctggccagctttcactcttttgtgatggccgtggacggaccctctgctggttttcacgctccgggtttgtctgcggtcagcacccttggtgagtgctggtcgtttgtttgctcattttgcttagttcaccattatctttmttctcttttgtwtggttttcctagcggttgtctgggagttgagctgcagttgtctggtcttggttttacccccatttgttttcttttaacgcggggcgtattgccttgaccggccgtctcagcttttctcctagagcaaccttccgttcatccaacttttagttttctcagttcttggccattccggttggttaatttttatttatacttaattttatgtttacattttctggttggagaccattttagcttgttttaatagcttttcttctttaattaataccctctgccattgagggtttttattactattaattttgtttactctttgtaacttgtttgattgaatattttaataaaccac

SEQ ID NO: 1068 - DNA, 4285 bp, Phytophthora sojae
agacgagcaacgcgctggggcccaagacctggcacgaacgacactgcccaggctgtgaacgacgagcacgctgctaacccggcagcgcaccggcctctgggctccgctgcaccggttaccggtgcaacacggtggggtccacgtcacggcgcgatcggggcagcggctgtagctcgcctgctcacaggcctacccacggcaccagcaccagctacgcgccggcctgcttcggctcggcgctgcccagacccgcccgctccccccgcggccacgacgacagcccccgatgcgatggacgtcgacggagggccggctatgcccgagccgtgggtgctccgcttcgacggcgcctgccgccggaacccgggacctggtggagctggtgccgccttgttcaagccgtgcgggaccgtggcgtggacgtgctcgcactacatgccaaacagcagcgagaccaacaacaccgctgaatacacggcgctgctgcttggcgtgcagagtgccgtccaccacggcgcctcgcacctggagatcgaaggtgacagccacctcgtcgtagcgcaggtcaagggcaccttcgcctgcaggaacccgcgcctccgccagctgcgcaaccgcgtccgccacgccctccgcgccgtgacgtccttaacgctcaagcacatcgaccggaaggcgaacgcgcacgcggacagactggcaaaccgggcgctggacctgaagcgttcgctggctgagtgcggcgagcaccaaggggcgatggagagctgcctccacatgaatcctgctgcacaacgccagcgcgagcaacccgcacctcctgcccgccccgcgtgcgcacccacgcgcgccgagtctgccagcgatcatgacgaggacatcgacgcagagattgccgcgcgcgacggcggcgaggcgttccccacgctgcctatcgggcccgggacggctccagcgcggcagccgcgccttcgactgcggcagctgaccgaagacgagcaggaagcggcggcgtcggccctgcaggccatggcggaggagctagcgtgcaagatcgaagacgcagacagctggacctcgggcgatggatacatcagcgccatccccagtcgcatccggcagttgctgcagcccttcacagcagcccagccccaccctcggcctccactgcaacagcagcgacagcgaccgccccgggtgacgcgcactcagcgcgagcatcgactcgacgaggccctcgacgagatggcggcggtgcagcaggagcgacccaccagcagatcggccgtccgccgtgcgcggcgccgcgtcggccggatccgcgcctcgatgcgccaacagcagctccgccacgacttcgctcgcaacgagagcaagtgcgtcgaggacattctgcgtgctgcgtcggcggagaccgcagcggaggagcacccggagacgtgccccatcgactcgggcacgctccacgagcacttcacggcggtgaactcgccccgcatcaacttcctaccagatgaagcttgcggggcgttgttccgcgaggcgatggccgacgtcgggacaccgcaggagcggcggagcgcgctcacggacgagctgacgatggacgaggtggaggaccagctcatgcaagcggccacgaactccagccccggccacgacggcgtgggctacgacatctacaagaagttcgcggcgcagctggtccccctcctccacgcagccttccagtcctgttggcgccaccaccgggtgcctgccctgtggaaggtggggttcgtccgcctcatccacaagaagggcgaccccaacgacccagcgaactggcggccgatctgcctgcagaccgcgatctacaagctctacagcggtctgctggcgcgtcggctgtcggcgtacctggaggcgaacgggctgctgctcatggcgcagaaggggttcagggcgtacaatggttgccacgagcacaacttcgtggcaaccacgctcctggaccaaacccgacgcatgcgccgcaggctgtaccaggtctggtacgacctgcggaacgcgttcgggtccgttcaccaggacatgctgtggtatgtgctccgcctgctcggcgtcgagcgtgcgttcgtcgagcgctgcgacgacatctacgaggactcctacttcgtcgtcggcaacgcggccgacggagcgacggaaccagtgcggcaggaggtgggcgtgtaccaaggctgtccgctcagccccctcctgttcatcgccgcgctggtgccgttgctccgagcattggagaagctcgacggagtgggcgtcgcgttggcggacggggtgcggccatgcaccaccgcctacgccgacgacctcaaggtgttcagcgacagcgcggccggcatcacgcgctgccacgctgtcgttgagaagttcctggagtggacggtgctgcaggccaatccaggcaagtgcgccttcctggccgtgacacgcaacgcgcgcggcaaccccgcccacgacaaggacatgaagctgtcgctccacgacgaggaggtctcaagcatcaagctgcacgacagctaccgctacctcggcgtgggcgacggcttcgatcacgtgcgccaccgtctccagctagagcccaagctacagcagatcaagcgggaggcggtggcgctgatgcagtcggggttggcgccgtggcaggtggtgaaggcgctcaagacctacgtctaccccaaggtcgagtacgcgctccgccacctccgaccgctccagtcccaactgcagggcttcgaccgtgtggtagccaagggcctgcggcacctgctacgcctgccccgctcggcaaccaacgaggtgctctacgcaccaacgtcgagcgggggcttggggctccagccgctggtggaaatgcaccgcgcgctgcagatcgcccatgcgtggcagatgctgcactcgaaggacccagcgatccgggaagtggcgcgcgcacaggtgtggcaggtggcccgcaagcgtcaccgcctccgcgaagaacactggcgggagcgtgacgacgagctcgtgcggtgcttcctcaactccgagctcgccgcctcgccccacgcggaggcgctgcgccgccacggcgacatcgggtcactgtggtccgacgtacagcggtggctgcgcatctaccacctcagcctggtggtgcaggacgaccgcaacggcctggacccgctcggcctccgcgtgccgcaccacgccaagtggctcgaccacaagagcgtgctgcggcacgtcaagttgcacctcaagatccgccaccagacccgatggaagggtctggcggaccagggcaagacggtgcgggcccacggcggtgtcggtgccaagttcatgtcgacatgggcgggcctgtcggacgacgactaccgcttcggcgtgaaggcccgcctcaaccagatcgacacgaacgccgtgctcaagcgcaagcggctgcggtcgcacaagacctgcagggacccgacctgctcctcggccgagacgctggcccatgtcctcaaccattgcgagtccaacatggacgcaatccgccagcgtcatgacgacgccttggagcagatcgggtccaagatccgcaacgcgctcaagcgcggcaagtcgaccgcggagctgcgcctgaaccagacggtacccgagtacacgggcgcagctctgcggccagacatcgtactgcggatcgtggccgccaagaagatggtgatcgccgacttggcggtcacgttcgaagagcacgcggccggcgcccgccactcctcgctgcagctcagccacgaccacaagacactcaagtaccaaccgatcgtggcggagctgcagctcaaggggtggcaggtgcagaccgcggcgatcgtgtacgggtcgctgggctcggtgcagcccagcaactcaacacctacacggaaaagttgaagctgcacaagcgcgaggctcgacagctggaccttcagctgtcgagccactgcatccgcgccagccaccgcacctggggctggtactgccggcgccaccgcgaaggacaacggagcggcaacgcctcgcgagcgccgcgtgggtctggggggggcccgcggcgcacatcgcaggctcgggcacggcggtaagctggtcatttgaccaacagggcactacccaggtagggaaccgcccttcaaaaacccaggaagacacaaacaccctccctttagtgacatgcatattttagcctacatttcagttacggagaggttactaactggtaaacacgaacacacat

SEQ ID NO: 1069 - DNA, 5108 bp, Pythium ultimum
gcggtgtacgcgcacaacgccgcgctcttcgagtgcacgttgtgcgcgcacaccgcgcgggatctcgccgcgctccagcagcatcggcgctccgcgcaccgcagcgtccgctttgtggatcacttccacagcggatgcgcgtgcggcgtgagcttccactcgcgtgcggcggcaaccaagcacgcgcgcgaatgtccagagagcgcgttctcggtcgccgccgccgcgcgcactgcagcggccaacaccgcaggtatgtctctcggcgccgacgaacgcgaccacctcgcgtccgtcggcgccttgcatgatgttgcatcccccgcttttggcaacattttgccggttgcgtttgcgaccgcggcagacgcatcaagcgccaccgtgatcgcagacgcagccatgcagcacagtgctgtgccctctgctgccgcccaatcccctcggcgtgcgcacgtcccccccgtgccgcgcgccaccacgacaccatccgcgctgcggattggtggcaaacgccgccgcctgaacgacgacggcgacaacgaaaacagcgacggccgcgacgccgacatcgagatgcgcgccgacgacaccgacgcaccagcgccgaccaaccccgcgaccagtgcggctgcaacgcccgcgcgcacagcaccagcaccaacggatgccgcgaccgcgcgccgccgccacacgcgatggggacccagagtgctcgtgaacgtggcgcgccttccgcgccgcactcacacacgctggggccccgcactccgccgcgaccaccagcatgcagcaaacatggagaactcgaatcagctgctggtggccgcgacggacaatgcagcgatggcgcggaacgcgagcgcgacgccgagcgcgacatccgcgccaacgagcgcgactgcaacggcgacggcgacggcgacgacgccgacagcgacagcgacgaccgcaacgacgcgcgacgacgcagcagacgaccgcgagcgacggcgacaacaacgacgagcgcgccgaccacgaccacgaccacgacaacgagcgcaacgacgagcgcgacgacgccggcgacagacagctccccctgggtcttgcgctttgacggcgcatgtcgccgcaacccaggccccggcggcgccggtgctgcgctcttcgagccaggtggcgccgtggtgtggacggtgtctcactacctcccgggcagtgagaccaacaacaccgccgagtactcggcgatgctgctcggggtgcgcagcgccatccaccacggcgcgacccgactccgcgtcgagggcgacagccacctcgcgctctcgcaggtgcgcggcaccttcgcgtgcacgaaccggcgtctgcgcaagctgcgcaaccgagtgcaagcggcactgcgcgagctcggcgactaccggctcgtgcacatcgaccggcaagcgaacgcgcatgccgaccgcctcgcgaaccgcgccctcgacctccgcaagaccaaggtcgactgcgggccccacgcaacgaccaccgacgcgtgcgtgcagccggcggaaatcctggcgccaacagcccgcctgtccagctccagctccagctccagctccagctccagcgacgagccgatgccgggactcgaggagccagctgcggacgacgagaccgacgctgacgccgaagccgacatcgcaatgcgcgatggaggcgagatttttccgacgctccagatcggccccggctcggcgccagcacaacaaccgcggctccgcctccgccagctctcggacgacgagtccgaggcagccgcgcgcacgctcgagcacttcgccaacgacatggcgagcaagattgcggacgctgacgactggcgttccggggagggctacatcagtgccatccctgtgcgcctccgtgaactcctcgcaccatatgcggtgccaatcaggagccctccacggaacgccagctcccgtcccccgcgcccgcaatctcgtccgcctcgcccgccgcgagtgactcgacaccagcgcgaacaccgactggatgaggcgctcgacgacctggccgctgcgcagcgctcgacatcgaccgaccagcgctccatccgcaacgcccggcgtcgagtcggccgcatccgcacggcacaagcccaatccgacctccgcagccagttcgccacgaacgagcgcgcctgcgtcgagagcatcctccgcgccgccaaacccgacggcaccgagcctcaagcaagcgcgggcacgtgccccatcgaccgtgcgacgctccacgcgcatttcgcgggcgtcaacacgccgcgcgagcgcttcgactttgacgacgcgctgggagccgactttcgcgccgcgctcgacgttctgccaccgccggaccaagccgccgatgcgttcgccgacgagctctcgctgggcgaggtcgaggaccagctcgaccgcgtcgtcgcctcctccagtcccggcctggacggagtgggctacgacgtgttcaagcgctttcggctgcagctcctgccgctcctccacgctgcataccagtgctgctggcgccaccgccgcgtgcctgcaacgtggaaggtgggattggtgcgcctgctgcacaagaaaggcgatcgcgctgagccaaacaactggcggccgatctgcttgcagcaggccatctacaaggtctactctgggctgctggcgcgccgactgtcgcggtggctcgaggcgaacgaacgcttcaccaccgcccagaaaggtttccgggagttcaacgggtgccacgagcacaatttcgtggcatcctcgctcctcgaccagacgcgtcggctccatcggaagctgtacgctgtctggtacgacttgcggaacgccttcggttcaatgccgcagcccctgatgtggcgcgtcctcgctcgcctcggagtcgacactgcgttcctccagcggtgcgaggacatctacgcggactcgtttttcgtcgtcggcaacgcagccgacggtgccacggaccccgtccgacaggaggtcggcgtctaccaaggatgcccgctgagcccgctgctgttcatctcagcattgattcctctcctgcgggctctgcagcggctaccaggcgtcggcgttcccctggcggacggagtccgtccgtgtacgaccgcgtacgcggacgacctcaaggtgttcagcgacagtgccgccggcatccagcaatgccacggcactgtcgctcgattcctccgatggacggggctgcgcgcgaacgcgagcaagtgtgcgctgctgccagtgacaaccactgcgcgcggcaaccccgccatcgacgacacgctgcagctcgagctgcacggcgacgccatcgcccgcctcaccctccaatcgagctatgcctaccttggggtgggtgatggcttcgaccacgtgcagcaccgcgtgcagctcgcgcccaagctcgcagagctgaagcgcgacgctgtggcactgctgcggtcggggttggcgccttggcaggtactgaaggccatcaaggtctatctgtacccgcgcatcgagtacgcgctgcgccacctccgaccgctgcagtcgcagctcgaggggtttgatcgcgcggtagcgaaggggttccgacacctcctccgtctacccgcgaacgccaccaacgagctgctctacgcgcctgtgtcgagcggcggcctggggcttctgccactcgtggagctccacaaagctctgcagattgcccacgggtggcagatgctccactcgaaagacgccgccgtgcaggcgatcgcgcgcgcacaggtccgccaagtggtccaaaagcgctacacgctggacgcggaccactggcagggacgagacgacgagctcgtgcagctctttctcaacagtgagctcgccgcctcgccccacgcgaccatcaagcggcgcaacggagacattggttcgctctggagcgatgtccagcgccacctgaagacgctgcagctccggctcgagacgcgcgagccgactgccgacgcgcctgactcccccaacggcctcctccacctccgtgtgccgcaccaccgcaaatggctcagccacaaaacggtgttgcggcacatgaagctccacatccgcttgtgccacaagcacaagtggcagagcatgagcgaccaggggcgcacggtgcgagcgcacggacaggctggcagccactttgtgtcgcgcggggtgggcctatgggacgcggactaccgcttcgcgctccaggcccgcctcaaccaactcgacaccaactcgacactcaagcgtcgccgccagcgcaccaatgccacctgccgcgcgccgaactgctcgcgcaccgagacactggcgcacgtcctcaatcattgcgaaaccaacatggacgtgatccgccagcgtcacgacggcgcgctcgagcagattggtgcggcgatcaacgctgccatcaagggccgccgcaccgacaccgaggtccgactcaaccagacagttccagagttcaacggaccggcgtggcggcccgacatccaggtgcgcgacgcgcgctccaagaccatggtgatcgcggacctcgcgatcaccttcgaggaccagccaaacgaccagtccgccagctcgtcgctccaacacagccgcgaacacaagatcgcgaaataccagccaatcgcggcggcactggagcggcaagggtggcgggtacacacaagtgccattgtgtacgggtcgctacgctcggtccaccccagcaacttcaccgtgtacacggagttgctgggactgctcaagcgcgacgcccgtcgcctgaacacaacgctgtcgtgccactgcatccgcagcagccgacgcgtgtggaactggcactgcggccagcacagagcacgacagcatcagcgatgccaagaaggccgcgcgcacgggtccggggggaaccagcgcgcggaagggggcacggcaacaacatgatgcgggtcatattgaccgaaagggcaccatccacgtaggacaccgccctcaaaaacccagttcagtttattgacaccctccacttagtgacatgcatattcaaaccgatacatattcgttaggagaggttactaactggtaatatatcaccatttc

SEQ ID NO: 1070 - DNA, 4391 bp, Strigamia maritima
ggagtgttcttttcggagacgccgcctactttagaggagagaatccccacgggcatcctcatttgatctgatccatcgagtatctgcgaatagtcggcgcactccttttgccatgatcccgggggtctcatggtaaaaaggtttgtggcacggcttagttgacgcccctcttccacgtcactcggcctgcatcgatcgactgctctctcctcttcctccctccctcctcttcacgctctcttcacgtgaccccttcccatcccgcccctcggcttttggcaaagatctgtgtgtcctccaaagcacccatctaccatttgctcgagttgcgattggtcgaagctgccacgccactcgtctactctgcctctctgaccccttcccccctctctccctctgccgccctcgcctctcgggtcccttcccatctccctcctcccatccacgtgctccctcctctcgtcacgtgatcgttgcggctcgacatggccacggtcagactcaagtacccctatcctcccgagggtatcttgtgtggaccgtgtgccgccaacacgaacgcccctcagacgcggccatactccgataagtcggggttggccaagcatctaaagctctatcacaaagccactctagtggtggagtgtcgtcactgtggtcacgaggagtctgatctgaggaagatgaagaagcacatctcgacgaaccaccccgtcgctgcggccgccgcgcctaccgtaccccctcgcctgggtcccaccgcccctcctccgccccgggttatcctccgccctcgcttcatcccacggcctcggactccctctccttcctcctcctcgtcatcggcgtcgtctccggcctcttccagaaggtctgtatcccttccccctgcgagtccccccgtctcctccgcttcctccccggccgctcgctcgggtcggaattcgccggactcgcaggggacggctccggtcactccgatcggtaccgtacggaactcgccggccggtagccctgccctcagctactcgacggcctccccgatcgcctctaccatcacgacgccacgccatctctcgcctgcgtcccccgctctctctgccgggcctggctctctcggcgcgtctccgcccgtctctcccacggccgctacagtaccccccgctcctccagctaccgtacccgcagtgatggcggctaccgtacccttcgtcgccgcgactaccgtaccctccgtcggctctagcacggtaccccagcgtcccgccggccctcgacgaccccctcccttccctatcgacgattggatcggaaggatcgcccgagtgtcatctctgccggaattggacgccgtctcaaggttgctcgaggatgaagtggtcaagagacgcccccctgaccccaacgccagacccgcctcactccatccgacacgccgccctccccctccatctactcgccctcgtccctgccatgggaccggcggaacttcagtctctctggcggcgctcacgtcctcgtgcattcgcgaagatcaccgagggagcctcccccttttgtgcacttccggttgggacagtccatggccactttctccaagtccatcaagccactgcccatcttccaacccctgtccctcttcctccactccgccctcctcgctcctcggaccccctcgtcactcccatctcacctggagaggttctggatcgactacgccgagccaccgacactgctcccgggccagataccatcatctactctgagtggagggccatcgacccgactggacgactcctctcctctctcttccagaaggtccagaccttcggggcgccaacccgatggaaggagagtacgaccacactcatccacaagggtggtgaccacacagcgatgtcctcttggcgtccaatcgccctcctctccacagtggccaagatctatgggagcatcctgtctcatcggctgacgacctgggccgtccagaatggtcgtctctcgctctcgcagaagggattcctgccatttcgaggatgcctcgaccagaactaccttgttcagtcgtgcctccaagacgcccgccgcaacaagaagacactctcactcgccttcctcgatctgaagaatgcctttgggagcatcccccacctgaccattcgtcactccctcgagtggctcggactggccccttcatcgatcgacattcttgaagcgtcattcctgggatcgtcgactcgcgttcgaaccgagactggactcactccccccatcagcctcgacactggagtggtccaaggagctcccctctcccccatcctcttcaatctagccatcgaacccctcctccgcacggtcccctctgcccattctggattttctctccatggccatgtcgtctctgtggtcgcctacgcggatgacctcgccatcctcgccccatctactcccgctctacaatcccaattggatgctatctctggcatggcagattgggcgggcctctcattcaatccggccaagtgcgcgaccgtcactctcactgggaaggataactctcgtgatacgctgtccctgcaaggctcccccgtcccttccatctctgacggcgatgcatacaagcaccttggagtccccactggcactactaccttccccagtggcaccgatgcaatcaagaagatgacgacggatctacaggccatagaccactccgacctcgcaccggcccagaagctagatgccctccgcactttcatcatgccccagctctccttccatctctctcacggctcagtccccaaagcccccctcactcaactggacaagaagatcaagcgggctgccaagcactggctgttccttcctcaacgagcctcgaacgaaatactgtacatgtcccacttgcacggagggcaatccctactccccctctcggtgctagcggacatcggacaagtgactcacgccgtcgctcttcttcaatcaagggatccagccgtggctgacctcgctctccggacttgccgagaagtcgcatcgaaacgggcaaagaagacggtcaacggccccgagttggcccagtacctctccgggtccactgacggaatctactgcaccccgacttctgacatcccgagtctctggacgactgcccgagctgcaacacgccgactctcctccactctgccactcacgtggacatccccccttccctctggcgtccccttcctttctatcaatgggtcccccctctccccattccgagtacagtccaccctcaccaatgccattagacataaccacctctccactctcattgccaaacgggaccagggaaattcctaccgtacctcacacgaccccgacccctctaactactgggtcaagggaggagacttcctccgattctgtgactggcgattcatacacagagcccgactgaacctcctcccagtgaacggggcgcgccgatgggacgcaaacagcatcaagacgtgccggcgctgtggtgcgcccaatgagacactcgcccacgtgctcaacgtctgccctgtcggactgccggagatgaagaagaggcacgatgcaattcatgcccgcatcaagaaagccctccgaccctctccccatacggtagtacaccacgaccggacagttcccggatgcggccccctgagaccggacattctgagaatcagcgagagagacaaatctgttgccattgtagatatccacgttcccttcgacaatggcactgatgcggttgagcgagctcacgagacaaagcgggcgaagtacgaactgatccggcggcactacgaacaccaagggtatcgagtcacgtttgactcactagtagtcacagcgcttggtagactgtggcgggggagtgaggcagcgctacaagcgctccagatctcgtcacagtatagtaagctcctccgtaagttactcgtggctgatgccatccacggctcgagaaacgtgtacgcccatcatatgaccggtatggttatgtgatgggagagtgaggaatcttctccactgtgcaaaaccatacagtcagaagatgctaactactagtttgataccctgtgccccctgcaatgtcccgcgtgtcgtacccaagcccggctggcattgagacacattaggctctcgctcccccgtatactctcataatttcgtgtacgctaatcctaccctacccctccctttgaccactcacccaaccatgtgtatagctgtgctggtgatcccggggcggttattcactggttatcatatcattctaaaatgatctttgatctctcaattaacaactaacttatttctgtttgtttcattgtttcacctcgtaagaggaagttcattgtgcgataaatcaa

SEQ ID NO: 1071 - DNA, 5560 bp, Strongylocentrotus purpuratus
aaggctcaaaccaggctgccaaccaagctgccagcttaggcaccaaccaagctgccagtccaggctccaaccaggctgcccaccaatctgccagcttaggctccaaccaagctgcccacctagctgccagcttaggcaccaaccaagctgccagccgaggatccaaccaggctgcccacctagctgccagcttaggctccaaccaagccgccagcccaggctccaaccaggttgccacccgaaagtctgccagtttaggcaccaaccaagctgccagccgaggctccaaccaggctgccactcgaggctccaaccaggctttcacccgaagcattacccaggctgcccgtttaggcacaaaccaggctgccagccgaggctccaaccaagcaaccagcccaggttccaatcaagctgccagccgaggctccaagtaagctgccagccgaggctccaaccaggctgccactcgaggctccaaccaggctttcacccgaagcattacccaggctgcccgtttaggcacaaaccaagctgccagccgaggctccaaccaagcaaccagcccaggttccaatcaagctgccagccgaggctccaaccaagctgccagccgaggctccaaccaggctgcccaccaagctgccaacttaggctccaaccaagctgccagcccaggctccaaccaggttgccacccgaatctctgccagtttaggcaccaaccaagctgccagcctaggctccaaccaggctgccactcgaggctccaaccaggctttcacccgaagcatcacccaggctgcccttttaggcacaaatcaagctgccagccgaggctccaaccaagcaaccagcccaggttccaatgaagctaccagccgaggctccaaccaagctgtcagccgaggctccaaccaggctgcccaccaagctgccagcttaggtaccaaccaagctgccagcccaggctccaaccaggttgccacccgaaactctgccagtttaggcaccaaccaagctgccagccgaggctccaaccaggctgccactcgaggctccaaccaggctttcaccccaagcatcaaccaggctgcccgtttaggcacaaaccaagctgccagccgaggctccaaccaggcctccaaccaagctaccagccgaagctctgccagattaggcaccaaccaagctgccaccgttagaggcccagagcccaccaatcccataacgtgtgagatatgtgaagcttccttccacacctccgccggtctccgtcgccacacggccaggcttcatcgcaccactgctgaacacactgacgacagcatgagccattccatcaccgaggtattcgactatccgttgccctcccgttggaagtgcacagtgtgcttagagaactttttcaatcagcagaccctcaagcgccaccaggcccggcaccaccaaacgacctccttcctctacgtctttcgatgctcagcctgccaggctgagtttgattctgctcgtaaggcttctaatcactggcagagccacaagaggaaaccaatcctctcacaaccagcagtgaatgaaatcccttcttcgggtctagatccatcccctccaaggtctcgtccaccggtcgaggtgattggttcttcttttccagatgatgtgtctatgctgtcagaaccatctaccccctctacatcactacaaatggacccagaggtggtgcatcctccgtcacgatccatatccttttcgcccatgcatcttagccccactcagccagccagcccgattcaaataggcgttgaggtttcctttaactcttccagctcacttcagatggacccagaggtcgtgcagcccccgtcaccgtccatttccttctcacccatgcatcttagccccactcagcccgccagcccgattcaaataggcgttgaggtttcctttaactcttccggctcacttcagatggacccagaggtggtacagcccccgtcaccgtccatctccttctcacccatgcatcttagccccacccaaccagtcagcccgattcaaataggcattgaggtttcctttacctcttccagcccacttcagatggaccccgaggtagtgcagcccccgtcaccctccatgtcctactcacccatgcatcttagcctcactcagccagacagccccatcccagtagacattgatgtcataccagcggctgaggtccccttgcctgatattgagattcctccttctccggatagacatccagcggctgaggtccccttgcctgatattgagattcctccttctccggatagacatccagtggctgaggtccccttgcctgatattgagattcctccttctccggatagacatccacaatcgcctccacgaccagtgatgatggagcagccagtccatacaccaccgccggccgatacacagcaggctaatggtccacagcattgggtgactgttctagccaacgccaccaattgggaagacttcgggagagtctgtgtagagtttgctaatcatgctgtagaagcagcccggtctcggcaagatgcacctcaagtaaggcctgctgcacagagacagcctcgcagaccgactagacctcgtcaacccacgtttgatgtcagggaggcaagccgtttgcagaagctctacaaacgcagcaagaaaagagcggttcggcacattctaagagatgacgccccctccttctctggcagcaatgagcaactgcttgactacttcaaagaaatctatgctcctcccgagattgatgaaaatagagcacaacagttggcagagtctctctttaccgatcttgaggaagcgaaggagtctgcggccgccctaatgtctcctatatctcagcaagagatcagtacacgcctttctcgaatgagcaattctgcccctggaaaggaccgcctcgagtatagacatattcgacaagctgatggtgcatgccgtgttacccacatcatgttcaacaggtgcctacaggaacaccgtataccatcagcatggaaggaagctacaaccatcctcattcacaagtccggtacaaccgatgacccagcaaacttccgcccgatcgcactccagtcatgcttgtacaaactcttcatgggcatcctctcagacagaatgacacagtgggcgtgcaatcacaaccttctcagcccagagcagaagagcgctcgcccatgtgagggatgtcatgaacacacctttcttctgtcgtctgtcatcaaagataccaagcgaaaccagaagactgccaacatcgcctggctagatcttaggaacgccttcggaagcatcccccaccaggctatccatgcagtcctgacaacgataggagcacctgtcagcctggttatgctcctgaaggacacatacacgggagcatccacatcctttcttagcacgagtggagagactgacccaatacagatccagtccggtgttaaacaaggatgcccgatgtctgccatcctcttcaacctaaccattgaacttatcatcagagccgtcaagaagaaggcaacggatgatggcctcgggcttgtggtgcatggacaacgcctatccatcatggcctacgctgacgacctcgtcctgatgagcaagacaccagaaggcctggatgccattttgtctgtggcatccgagcaggcagaaaccctacgtctggcattcaagcctaccaagtgtgcctccctctcactctcatgtagacacggtacatctgtccttccacgcgaatacaccgtccaaggtcacctgatgccagctctcgacgaggaagagcagtaccgctacctcggagttcccttcggcttacctcgtttcacaaatctcaaggacctgatcggcaagctgaagggaaacatcgagaccattgcatcatcattgctggccccatggcaaaagttggatgcaatcaaaaccttcgtccaaccaggtctcagtttcgtactgcgggcagcggactacttgaagtcggacttgcgttctctgaaatctgccatcaccaccaacgtcaaaaagatatgccagcttccccttcgggcggccaacgcatacatcttcgcggctaaggaatcgggtggtctagccttcatagaccccaacgtagatgcggacatccaagtcatcactcaagccgttcgtgtcctgtcgtctgacgatgaagtcgttcagacaatagcaacatcccaactcaagtcggttgttcatcgcacaatccacgcagtccctactgaagaggacatcgacaactacttgtctggcagcaacgagggcctgcttgccaattcgggtaatagcggccaagcttcttctctgtggtctcgaaccaggtcagccgcaagaagacttcatcttaccctcagagccaccaccagtggtacagttgttgtcaaccagcaggcagacatcgaccacacaagggacattctaccagcatcaataacaagaggactgaggctcatccaacgaaccacaaatgctgagaaactcaagtccctaccagaccaagggaaagttgccagatccctcagcaacgatccattcgctaacggctcttcttggcatgcaactggaaagttcatccgcttctgcgattggcggttcattcaccgagccagactgaactgcctccccacgaatgtagccacgaagaggtggaaggcaaatgcgaatggcaagaatggccatcaacaagagacactgcctcacgtactgaatcattgcctacccaacatggtccccatcagacgccgccatgacaacatccaacaacgactggtaacagccatcagacatggcgatgtctttgtcaatcaacatgtaccgggagaccccaacccaagagaacgcccagatatcactgttatcgagggaaacaaagtcacagtcatcgatatttctgtccccttcgacaatggtcccaacgcatgcaccacagctgcacaagccaaagtcgaaaagtactctgccctccgtcaagccttgagagatatgggaagagacgtcgaagtccatggcttcatagttggtgccttaggaacctggcaccagggcaacgaacgtgctctcggacgcctgggtgtcagtcgctggtacagaacactgatgagaaagctgtgctgcattgatgctatccaagcttccagagacatttgggttgaacatgtcactggacatcgacagtacgagtgacgaaatgttcaatatatgacattctaatgttcatgtattttttgtttgcttgacaaagctagatgaatatattccctgtcctactacatacatctcgatgtgcccttgctagacgatccattggtaaccatgatatcaatggattaacacatgatctgtaaacaatatatgatttacacaatgtatttattgtttcaataaatctgttcttttcactttaatacatgaaacatgactgtgccttctccaactggagacctacataatttgttaaaatgatataaatatttcgaagatgaaattattattaataa

SEQ ID NO: 1072 - DNA, 5469 bp, Trichinella spiralis
tttctggtatgaatcccaagcggattcgttacgaaatttgcataagtttttgaaaaaataggcatttggtcgagtgctcgcaccaccatttgtcgcgggtcgtcctgatattgcactacattcaggaacggcctattcccttcggggaattgtgttttaggaattggaatcggtttggttacgatcggtcgagtggttcgtgagatcgagtgacagccgggtggcagcgacaatgtgtagtgcaaagacaccagccttgaagtcgggtcgccgtcgcggaaaagaggtcaactatgaaggccaaattgtacgggtagaaagacggcgtggatctcgcagtagtacgagcgcaacggaccttggtacgaggatggttacgcgtgggcgaaagaagctgatggaggcgtcggttcgtgaagcgggtcaccacggaggtgaatcggcgagtactgtggacgtcgacgtggtggaatcgaagaaaattacgggtaaaacggcgcgccgtaatagaagagcgccaagcggtgatggaaaaagacgagagagctgtggtgcggaatgtggccaagccgtatgcggtaacgctgttgcggaccgtagtgaggccagttcgccccgcactcccaacgttagtaaatctggtcgtgacaagtgtggtcaacccactataaaagcctccacaccatcaccaccgaaaagaaaaccgaccacttcgagtagcccacgtacgccatgcctctccaagcgcggagcgagatccaaaattccgtccacgccagatacaccatcgacttctggcggttcaggtaagcaacgtgttttggtgtcgccgttgcttaggacggaaaaattgcccgacctcgaagttctacaaagaaccgaggaacaggtgactgtacgggcaactttcccaatcgcccaggcggtggtctgcccactgggatgcgagaaaccgtacacggccgtgagaccagacggtcaatttgcgcaccaaacgctgactcgtcatttcatgcgagtccacaattgtcacagcgtccagtggcattaccggtgtcgcaattgtaatacggatttcttgccggcagatcaccggtatcccctccgagttgtgaacacccacgttcgcagctgtgttagccggtgggagataacccggaagttgggagagagcgaagatttgcatggagttcgttgcgatctttgcgattacgtaggcgtgtcgaaaagagccgtcggattgcatcgccgccggcacgccaacgagaacattatgcaaaatacgggtacggccgctcaaatcgaggccttgagcaaacaagtcggcgaaatacgtgtagcaggcgactatagtcagtttaagtttggtaaacgggttcggcaatacgtggcaccaacgcagaggcgagacgggttggacgaagaggaggttcatgaagccgaagaagaggaggtgccagccgaatcacgtaccatcctaggtgaacccagcaccgcaactgctataggagctgaggagatctctgcaacgggtccagttcgagcagacacagctgctcagcagatgatctgccggatcgggcaatggtgtgtctggccgcaggactaccattcgatcccggcacctcagtgctggacggacacgttgatggacctcatgattgaacaaatcgttctgcagcgctatcccgatggtgcgggtgtgagcgtgatgagctgctcagcagtaagcgcagccatacaccacgagatatctgcagagtttgccgctcaggtcatgtcttcacatgatgccagtttgtattgcatcattcctgtgaatgtacgtaatcattggcagatgattgtgctggatgtggctgaacgagtagtccattactactgttctctccgcgagcataacactgttgttttatcgtctctgttatcgctagtggagctgagtggtaagcacactggctgcacctcgtggaagatcgagactcacgatggcgcgccggtgcaaacgaatgcgttcgattgtggtccgttttcgtgcttgtttttgaagcacctgctgcacggcatcgacatgaatttcggtgatcgggagtcggcggctttgcgcaccgacctgaagtttatgatcgatgcggtatccactcccgtcgttccggcgacggataagctaaagaaaaaacctgacggctcagcgactcagttgacccagttccagcagaagttcctgagcgcttctgacaactggcaatctcctgatgtcgacttgcaagcggtgtatgacgaagtggtggagagtattgtgtccggacacaatgaaccgagctctcgtaacaccagccgtttgcaaaagaaaagtccgggtaaaggaggtaaaggacaggttcgccgacgcagtgcggtaacgcgtgacccggcatggttgaaatctgcgtcagcggttcaaaaggcgttcaattcggcaccggcccgtactgtgaatgcaatcctccggcgtccgaatgcctgtccttcgtttacagccacgcaagtggcagatcattatttcaatctcagaccggcggttacctcgcttgcacccgaggttattgacatcttacctccgcccgccactgaccactcgatgcttgttgcggagttgagtgagtcggaggtctgggaaaagatgcagaaagcacccaactctgcgcctggtgcggacaggatcaccattcgtatggtgcggatggcagatccaggtgcgatgattctcaccaggttctaccgtgcctgtctactaagaaaatgggtgcccctgcaatggaagcaatccgtgtgcaagctcctttataaggacggggataaggagcgcctcgccaactggcggcctatcgccctggagcccgtgttacagcgggtgctcagtgcggtagtcgccagcagagtgacgaactgggcgagggcaaacgggttgatttccttggaagcccagaaaggcttccagccagctgatggtacctccgagcacaatttcgtcatggaggttgcaattcaagaggcaagacgcactaatgcacagcttgccatcagctggttagacatctccaacgcctttggcacagtgtcgcaccaattgttgttttcgttgttggagcgctatgggctggacccgacttttaccagttttatccagaatttgtataaagacgcgaccattgtagtcaaaggcgccaatggaacccacgttaccgcgcgctggtcagtcggagtacgccaaggtgacccttgcagtggtatcttgttttgtttgtttgttgagccactcttgcggtcagtcttaccatctttaccgtgtgaggcggaaacgactgcggttaacgtgttaggacagccgatcacagcgctggcttacgctgatgacatcgcgctgttcgccccatccatcggggttatgcaacaacagctgtgcaaaatccagggcatggccagcgccatgggctttcggttcaacccgaagaagtgcgcgtccctgtacttgaatcgtgcagtagtgaatgccgcaacattcacgataagcggggaggaaatacctgctctcgtacacggggacacttttcgctatcttggagtagccgctgggctgggtaaaccccagactcctttctcattactgcgtgagaacctccgagaagcggaacttatattccggtcaaagctggctccgtggcagaagatggatgcgtaccggacttacgtactgccacgtttgacatttcagcttatgattgctaaatttaacaacatcaagcaatcggccgggcagtatgaccgcgcaatattgaggctcgtgaagcgttgcttccagcttccggtggagacgtccaccgacttcattagagcccccagacagtgtggtggtctgggcgtgccatcattgcgtgagttgtacgcaaccgcaaaggtttcgcgggcactcaagatgctctggtctccctgtcgggtagtctcgagcctggcagccagtcagcttcagcgagttgcgtccgcgtactttgcgaagaggttgagagatgttgaggcggctgacctctctaccttcatgaacgccgcgcgatctacgccgctagatcggtcagggtatccgacttgcttgtggatggacgcacgcaagcagatgtcgtacctgacaaaggtagccggcgttgactgttacttcctcgttggcgaggctgggacctctttcttcatccggaatggcctcggtcagacggtctcagttctaagccccttgaggaagaacaaagttatgagcgttttagggggggcgatccaaactcgccatctggacgcctggctccaatgcaagcgccaaggtaagactgcgagctgcattgtgctcgaccggtcatcctcccgttttataacgaccggacggtacaccagctttgcagctatgcgctttgcgttgcccgctcgcctggatttgttaccttgccgggcgagatcctctatgcgttcgtaccagaactgtcggcggtgcggttacgaccgagagaccctgccgcacatccttcagcactgtcggcagttcagcgcccccgcttaccaggcccggcatgacgcagttcagggacgcctggaaacggtcatgcgtaggcggttccccaacctccgcgtaaaccgggctctaccggagattgggtcgaacaagcggcctgatctagtggtcgttgacgaggaaaagcggttagtgattctgcttgatatcgcaatcgtgtttgaaaacactgccgctgccttcgtcgatgcccggaccaggaagtgggcgcactatgaaaaggagatcctcgcctaccggctacgaggatactccgtgacgtacgacgccatcgtcgtcggtgctctggggacgtgggacccgaagaacgatgccatcctgaaaaggatcggtgtcgtctcccaaaggtacctacggctcatgaaggttctcgtggtgtccgagatgttggaacattcttcacggatctacagaaaacacctcggcctgcgagaccttctcccggacaccggcacgaaacggcgaccggttggcacgacggagacagacccacccggtggtgatctccgtcagaagaagcgcaataccatcagcgctagggcatcaggtgggaaatgcctggaacggcggttcacgtcacccgtcgggacgccctcgcagcgtggtgagctgcagtgccaaccgtgccctggccctagaagacccgccctcgctggaatagcgcccaacccgcctagtctccagcccagaaaaccacccccgcggcaacaccagaagccggttacgaagtctacagcgcattgatccgtcccgaaccaacggaaccacattgccgcatgacttcgatttcgcttttgctctttttgtatttaattttgctattaacaattcagtttgttaactgttttgtattcatttgaagatccaaataaaac

SEQ ID NO: 1073 - DNA, 4906 bp, Chelonia mydas
ggcagaaactgcacsttctagaagactcactgcctatcctgaggaagactaccgctttggagatggattctactgccgctgcttcaaaagaaaatcttcatgctgcttcggaggctccaggacagastgagaagatgatcgctccctcgccgattccacagaaaccttcaactgccgctcggaccgctgctgctccacggagcgcccatcggggaacagcctctaagagaccctcagcgcttccaggacatcgcagatgagcagcatcgattggaaaagcagcgcctccctgaagaaaacccgtggagatgctgctgcagggawatcttgcacctcgaggacggcctcccaggacatcgcagccaggacaaacatcatctcgcctgctcttcaggasaaggatgccmsaagaacttmtcccacctcctcmactgcccaggatcctsatgctggtcgtcgtcctgctgtgctggaagmkaccccaactggcgagacctcagaaaccacccagmwggacckcaacatctcactagatgcctgcccagccgaacctctccatgcwactctcccagagcaacsagaaccatccagmgaatccgctgatatgactgaagccmatccaacagagggagaaggaaaggagaatgactgcatctatctccagtatcccctccctacggacacgctcctctkccccttccgctatccgagggttccagtacattggcagtctcagcamacacctcaagagaatccatascaagcggatcaccttccggtgtgccctctscgacctgcctttcgagacgcagatgaaatgtaagtctcatcaagtcacctgcaaaggacatctcgaactggaagagtccaactttaccagtctatgttgccgccaccccatctctgctccgaaagcagaaacaccacatgctccagctccggcttccgactccccaaacactccggctactgcatcccagccaactcccccagagccacagcacgaagaggtggtccaacatctatgaggaaagggcccgggcgcccaaggatactaccattgaaagagtaagtgctgcctcaaaaatccctaagctggaccctgccaagaggaggatcggcgctcccttgcagcttatgcaaggcaactccatctccagacagcttagtgcttcctcgcagtatgtccagcacaacgccgtcgtcagaagggtcagcgcccctccacacacgggtaacttcacgggatcctgtcgtcggaagctagcactacctcacaggccacccagcgagacccagccagcggagagctatctccactgctggaccacgcaacgggaccccaccctagcggaccagcacggcctccaagaccacccaacgggattgcccccagaaggctcacactgcatcaaagaccccagacagaactcatccacagaagggcagcgtcgctccggaaactcccaagcaagacgcatccctaaaagggccagtaccgctgcctctaaaactgtccttcctaaaaggaccagtgctgccctaaaatccgtaagggaagacactgccctcgttctggaagatccggccaaatggagttctcaacaccgggagggaaawaggcaacaggctaatcccacagcagttttccagcctgagcctgcggagattgagcagcagcccwcggtgagggccgccacaccatggcaagccgcttggatggaggagttggcgaggacagcctccttcgakgactttgacctccttgtagacagactcactaaagacctgtctgcagaaattgtatctgggaggaagggaactcaggagaacacaccaactgckcacagacagaaccaaaacaacatgagggaagccaggagaaggaacatcagtcgctgctatgacccagcagcagcatccaggatccagaagctctaccggtcaaaccgccctaaggctatgagagagatcctcgatgggccctcatcctactgcgcaatcccgtccgagagactattcttgtacttcaagggggtgtttgaccgtgtagctcagaacgacatgcagcgtccagagtgccttcakccttwaccccgggttgactatgcagaggaccwggaacaagactttacatcatgggaagtagaggccagacttacaaagaccaaaaacacagccccaggaaaagatggcattcgctacaacttcctgaaaaaacgagaccccggttgcctggtactaactgccattttcaacaaatgcaaacagttccgccgtactcccagctcctggaagaaatctatgatggtgctcgtctacaagaaaggcaagcaagacaaccccaacactcggagacccatctctctctgttccaccatgtacaaactgtatgccagctgccttgcggctaggatcacagactggtcggtgaacggaggagccatcagctccatccagaaaggcttcatgtcatgcaaaggctgctacgaacacaactttgtccttcagactgccatccacatggccaggagggcatggaggcaatgtgccatagcatggctcgacctggctaatgcttttggatcgatgccccaccagcacatttttgacatgctgcgagagttcgggatgcctgaaaactttctccaactggtccgggaactgtatgaaggctgcaccaccaccatctgctccatggaaggagagacacccgaaattcctatccgtagcggcgtgaagcaaggctgccccctgagccccatcgttttcaacttagccatggagccgctcattcgagcgatctccagcggtctaggcggtttcgatctgtatgacaacagagtgaatatcctggcctacgcagacgatctggtcctgatcgcagacaaccccgagagtctccaacaaatgcttgacatcaccagccaggctgccaactggatgggactccgcttcaatgccaggaagtgtgcatccctgcatatcgatggcagtagaagggattcggtccaggcgacgtcttttcagatccagggtgaacccatgatcttcctcgaggacgggcaagcgtaccaacatctcggcacgccgacgggtttccgcgtccagcagacacctgaggataccatcgcggagatcctacgagatgtggccaggatcgactcctccctactggcaccatggcagaagatcaacgccttgaacaccttcctgatcccccgtatctcattcgtcctgaggggatctgccatggtgaaggtacctctgaacaaggcagacaacaccatccggcagctggtgaagaagtggatgtttcttccccagagggccagcaatgaactggtgtacatctcgcacaggcagggcggtgccaacgtccctcgaatgggtgatctgtgcgacgttgccgtgatcactcatgccttccgccttctgacgtgcccggatgccatggtgaggaacatcgcggagagtgctctgcaggatgccgtcaagaagcgaatcgccaggaccccctccaaccaagatgttgccacctacctgagcggctcgctggaaggcgaatttggaagagacgggggagactttgcttcgctctggactcgtgcccgcaatgctacgcgacgactggagaagcgtatcggctgccactggacgtggtgcgaggaacgccaggagctgggagtcctggtgccacaggtgaagaacacagatcacactatcatcactccgagagctagaaccatgctggagaggaccctgaaggatgccatccgctgccaatacgtggaaaacctgaaacggaagccggaccagggcaaggcattcgaggtgacgtgcaagtgggatgccagcaaccacttcctccccgggggcagcttcacccgatttgccgactggaggttcatccacagggcccggctcaactgcgtcccgctgaacggagccgtccgccacgggaatcgggacaagcgatgcaggaagtgcggctatgccaacgagacgctaccccacgtcctgtgtagctgcaagccccattccagagcctggcagctgcgacacaacgccatccaagatcgcctggccagagccatcccgccacccgtggggaaggttgccgtaaactccgccatccccggaaccgacagccaactgcgaccggacatcgtcatcaccaacgaggaccggaagaagatcatcatggtggacgtcacagtgcccttcgagaacaggaccccagccttccacgatgcccgagctcgaaaggtggagaaatatgcccctctggccgaaaccttgagagctaagggttaccaggtccagacacacgcgctgatcgtcggagccttgggcgcatgggaccccagtaacgagcgagtgctgagagaatgcggaatcggtcaacgctacgctcggctgatgcggcaactcatggtgtcagatgccatcaggtggtcgagggacatctacatagaacacatcaccggacatcggcaataccaggagggatgagctggagtgccgatgagaagcgcagtcgggaaagtaactgaaatactttcctcatggattgtattttctaaatggacaacctacctaattctcaattactgagggacaatctccactcattgatatattttgctttccacaaccaaatctctgtacaacttttcatgagtgatgtacccgagtacttggattctaatatctaaactgtattgttaaatctattcacctaaatttgggttattgctgattatgtactctatgtatcatatgacttttaaaaacaaactttgtatttgtggataatctaagcactatacccagatgtacagacactcttttcccaacctatgtattatatttttttaacattagctttaataaaatttttaaa

SEQ ID NO: 1074 - DNA, 5390 bp, Phytophthora capsici
  modified_base (125)..(125): a, c, t, g, unknown or other
  modified_base (574)..(574): a, c, t, g, unknown or other
  modified_base (588)..(588): a, c, t, g, unknown or other
  modified_base (611)..(611): a, c, t, g, unknown or other
accgcccaagtctccaccgcagctgcgactgctgctgctcatcgagccgcagtagtcgcagctgtacaagcaccacctcctaccggacgcgccgtcgtggagcaccacgcgcgcgctgagccgcntcaagaccaagaattccaggctcgcgcgcgcgtggcgcttcaagatggcgacgcgaccagcaggagtggccgctctactgacggcggagacgaggccaagaccgaggacagcgacgcggacgcagccaagcgccaagccgctcaagcagcaccgagaccccatacccmggacaccgcgccgtacgacggccacagggactcggtgctggctgtgtacgcacacaacgcacctgcattcacctgcgcgttgtgtgtgtacacagcacgcaacttcgccgagctgaccaagcatcgccatgcagcgcatcgtcacacccgcttcgtggatcacttccacagcgggtgcacgtgtggcatcggcttccagtcgcgcgcggcagctacgcgacacgctcaagcctgtgcagacagcacacacgccaccgtagctgcctcgcgcgacccggcmnccastgcssccsgngccggmagcgasgaggaggaccncgcaccccccggtcctctsstcgcggcagcatctgcagctgcagcagccgcatcaagcgccactccagctgcagatactgccaccacgcagagcgccgtgcccatcgctactcctgggccccagtacgccccccacgtgctggagccacctccagagctccgagtttccggcaaacgccgmcgcctcaacacgccgatcgacctgcagccgctggacgtggacgcgctgatgcaggacatggaggaggagctgctcctggacgtggagatggagacggagacgacggaaccgcagacctcgacggccamggacgccaccaccaccacggacaggccaacacgatggggcccccaccccagagcagtggcggctgcagccatmgcgcagctggtgaccggcgagscagcagmtccagctctgccttcgagacaggaccgccgcccagcaccacgatcccacgcacccacccggtctcgatggggaccgcgccatcaagctgtcggtgccgcagccatcgcgtcgctagctacaggactaccggcctctgcggcacccgtgtctcgcgcaaccaagcacggggaaggacgacgccgtctccagacacgatggggacctcgggtgagcatcccacgagccgcacgccgtccaggatcgaggtggggacctccacgcgcggcaggggcctctggccaacttcctgccagcgcctccggggccactggccaacttccggagcatgtggaggccatcaccacgacaccacgtgtggcatcggacgctgatgaaggaccgacaccgccggatccgtggatactccgcttcgacggcgcatgcaggcgtaaccccggaccgggcggtgcaggtgctgcattgtttaagccgagtggcgccgtggtgtggacgtgctcccactacatgccaagcagcaacgaaaccaacaacaccgccgagtacacggcactgctgctgggcgtacagagcgcggtccaccacggtgccactcgcctagacatcgagggcgacagcagcctggtgattgcccaggtcaagggcacattcgcgtgcaggaacgcgaaactccggcagctccgcaaccgcgtccggcatgcgctccgctccgtggagaagtacaccctccgccacatcgaccgcaaggccaacgcccacgcagaccgtctggccaaccgcgcgctggaccggcggtcgagcagcagcgagtgcgagccacacggctcgtgcatggagcgatgctgtggcaccgacacgacaccagcggtgcaaggaccgacaccgcaagcagcagcagcagtgccagtgcaggtgtggccccagtggcagcggcagacgatggtagcgtggacgacgagccatggaggtcgatgccgagattgcagcacgagatgcgggcgaagccttcccagtcttgcccatcggcccaggctcagccccaggcggcaacctcggcttcgactgcgccaactcagcgacgaggaacgcgacrmagcagcggacgccctccaggagcttagcgacgtcatggccagcaagatcgttgacgcagacagttgggacaccggcgaaggctacatcagctccataccggagcgcatccgagaggtgctgcagccgtacaccacgcgaccaccacggcctgggcaccagcagcagcaacggcgacggccaccacgtgtgacacgcaaccagcgcgaacaccggctagacgaagcgctggacgacatgcaagccacgcagcaagcagcaccgcgggaccaacgggcgatacatcgagcgcggcgtcgcgtcgggcgtgtccgggcatcgatggccaagcaagagctacggcaggcgttcgccaaggacgagtccaagtgtgtgtccaagatattggccggtgcctcggcggagacagcggcggaagagcacgtcgacgagtgcccgattgacgccgccacgctgcatgcccacttcacaggcaccaatgcgccacggacggacttcgactacgacgctgcatgcggtcaagaattccgaggagcgctggacagcatgcagccgccgaccgttgcgaccgacgcgttcgaggaagagttgacgatcgacgaggtggaggaccagcttacacgcgcggccaagacctccagcccgggacatgacggcatcggctacgacatctacagtcgcttcgccgcgcagctcgtgccactgctccacgccgcgtaccagttctgctggctgcatcggcgcgtgccagccctgtggaagttgggcatcgtccgcctcatccacaagaagggcgacccgatgcagccaacgaactggcgaccgatctgtctgcagcccgcgatttacaagatctacagcggactgctggcgcgtcggctgtcgcgctggatggagcagaaccagcgactccccatggcacagaaggggttccgagcgttcaatggttgccacgaacacaatttcgtggcaaccacgctcctggatcagacgcgccggtcgcaccgcaggctgtaccaagtctggtacgacctgcggaacgcgttcgggtcactgccgcagcagctcatgtggagcgtgctccgccacctcggcgtcgacgcaagcttcatcgcccggtgcaagaacatctaccaagactcggctttcgtggtggcgaacgcggtggacggcgcgacggatcctgtccgccaggaggtgggcgtgtaccaaggttgtcccctgagccccctcctcttcatctcggcgcttgtgccgctcattcgccgcctcgagaagctcgacggcgtaggggtgccgttggccgagggtgtacgaccgtgtgccaccgcctacgccgacgacatcaaggtgttcagtgacagcgccgctggcatccgtaaatgccacgacgctgtcactcgtttcctcgagtggacaggcctgcgggcaaaccccggcaagtgtgccagcctagcggtgacgacaaacgcccgcggcaacccggtccgcgacgacggcgtgcacctagagctgcaaggcgaagtcatcgcccccctcagtctccacgatagctatcgctacctgggtgtgggcgatggcttcgaccatgtgcgccaccgcctccagcttgaacccaagctccaacagatcaagcgagaggcggtggcgctgatgcagtccggactggcggggtggcaggtggtgaaggcgctcaagaccttcgtgtaccccaaggtcgagtacgcgctgcgccacctacgaccactccagtcccagctccaaggcttcgaccgcgccgtcgtccgtggcctgcgccacctactgcgcctcccccagtccgccaccaccgagttcttctacacaccaacgtctggaggtgggctggggctgcagtccctcgtggagatgcatcaggcgctgcaggtggcgcatgcctggcagatgctccattccaaggacgcggccgtcgtggccgttgcgaaggagcaggtctgccaggtagcacgcaagcgctaccgcctgcaggaagaacattggcgcgggcgtggcgacgagctcgtgaggctcttcctcaactccgagctcgccgcctcgcccttcgctgactgcctccgccgcaacggcgacatcggatccctctggacggacgtgcagcgcacgctccgcctccatcacctcagcctgacggctcaagacgacagagatggccaagacccgcttgcccttcgcgtgccgcaccacaccaagtggctcgaccacaagactgtgctgcggcacgtgaagttgcacatgaagatccgccaccagacccgatggaaggggctagtggaccagggcaagacggtacgcgtgcacggtggcctcggtgcgaagttcgtgtcgaccggggcggggctgtcggacgacgcataccggttcggcgtgaaggcccgcctcaaccaggtcgacacgaacgccgtgctcaagcgcaagcggctgcggtccagcaagacctgcagagacccgacctgctcctcggccgagacgctggctcatgctctcaatcactgcgcgtccaacatggacgccatccgccagcgtcatgacgacgccttagagcagatcgggtccaagatccgcggcgcgcttgagcgagccaagtcgaccacagagctgcgcctgaaccagacggtgcctgagtatacaggcgcagctctgcgacccgacatcgtcctgcggaacgtggccgccaagaagatggtgatcgccgacttggcagtcacgttcgaggaccacgcggccggcgctcgtcactcctcgctgcagctcagccacgatcacaagacactcaagtaccagccaatcgtggcagagctgcgggtgcaggggtggcaggtgcagaccgcggcgattgtgtacgggtcgctgggctcggtgcagcccagcaacttcaagacgtacaccgagaagttgaagttgcacaagcgcgaggctcgacagctggatcttcaactgtcgagccactgcattcaagccagccaccgcatctggggctggcattgccggcgccatcgcgaaggacaacgaagcggcaatacctcgcgagcatcgcgtgggtctggggggaccccgcggcgcacatcgcaggtaagggcacggcgataagctggtcatttgaccgacagggcactacccaggtagggaaccgcccttcagaaacccaggaagacacaaacaccctccctttagtgacatacatattttaggctacatttcagttacggagaggttactaactggtaaataaaaagcacttt

SEQ ID NO: 1075 - DNA, 6828 bp, Phytophthora infestans
gctcggcctcgcggctgccttcccaggcgccgccgacttcgcgctctggcgcggcccacacgccgccgccgagcctccaagcgcgcccgttggcttccgcagacgcagggctcgcggcgacggccctcgccagcccccaagaccccccctacgatgtggcaccacccggcagggcggccggcaggctgcccgactcggtatcgccgggtgctacactctcagccgccacagctcgggccttggcggtccgccattggcccttggagctcgacagcgacagcagcgacgacgaggacgctcaagacccccacgccgccgccccaggaccccccgcagacgtcgcgagtgtgcttgccccacccggcaaggcaggcagcatgctcgccgacccagcagcgctggcagccggtctggctcgcgctccgccgcccccatcggcaccccaggacccaagccccgccttccctgctggccccgccggccagaaccctcgcgccgccgccccagcccgtgttgaagtccacacagtcgtggcaccacccggcagggcgggcggcatgctgcccgacccggggttggttgactcaagcccagcagcggctaccgcagctactccagctccggtagctgctactgctacaactgctcgcgctgctgctcgcgtcgccgtggagcaccacgcgcacgctgagccgaaccaagaacatctaccgatggctcgcgtgctcgtggagcccatgcaggtcgacgagtgcagcagctgcgaccgcagcactttgacagccgacgacgggagcggtgacgacgttgcagccccaagctccatgctcagcaacgacgtcgccgcccccatggacgttgactccggcaccagttgccctccaacgttgcagcagccgctccagcgaccgcgtgcgctgcacgtaggcagcaagcgccgccgactcgacgcagatgacggtgaagaagctcaccagctgcaagaagaggaggaggctggcattcatgccccagcgctcaggctatccgcggccagcgctcaaccggcctccgtcctcgccgtgtacacgcacaacgcgtcgcggttcgactgcacgctgtgcgcgtacacggccggcagcttcgcgtcacttctgacgcacaggaactctcggcaccgccgcaccgcattcctcgaccgattctcggcgggttgcgcgtgtggcgtgccattcgcctcgaggctggctgcagcaagacacgcgcaagcgtgcgccagcctctcgagcgcaccatcggccgaggcttcgtcggcagcaggaacatcaagccccactgccgacggagccgactccaccgtctcagccgtggctcacgctgagcccggcctgccccaccacaacgacacggagctcacagcgtcccccccgctggtgagctcctccgatgttgaagtgcaggcaacaaagaccgaagccaccgacaaccgctggggcgccccgcttccgcgcgtgctggtcgcgtctcgaatcgccgggcgcctcgctcaggtgccacccccacgctggggccccccgctgccgcgcaccaccatcgcagcccgcattgcgacgaggctcgcagccacgcctgccccccgctgggacccaccgctgccacgaagcctggttgtgtcacgcatcgccgcccgcctgctacccgcgctaccagacgcgcctgcatgcgaggaagaggccaaggacagcgacacgatggactgggcgccaacttggacaaacgaggagaccaaggaaagcgagccacatgacgaagcgccagggcaggtcgacgaggagaccatcgacgacgccgacggcgagtggcttttgcgcttcgacggtgcttgccgtgcaaacccaggcccaggcggcgccggcgcagctctcttcaagcccagcggccccgtagtgtggacttgttcccactacgacccgagcaccacggcaacgaacaacacagcagagtacactgcgttgctgctcggggccagggccgccgccgaccacggcgtcacgaagctgcgcatcgagggcgacagcacgctggtcatccagcaagtgcggggcatcttcgcgacgagaagcacgcggctccgagcactgcgcaacaaggtcaagctcgagctcgcgcgcgtggggagcttctcgctccaccacatcgaccggcaggcgaacggtcacgccgaccgccttgccaacgccggcctcgaccgacgccgcaccaagctcgagtgcagtgtgcaccccgatggcaggggctgcaccaacacctccgtggcgaccgcagcgcctactgctcctgcagcgcccttgccctcagcccggcctcctgcatctacggccgctccgtctcctgatgacgaccacagcgaccaaggcgacatcgacgacggcgaggtgtacgccgcaatgtgcatcagccccgatgctgtgccgcaccgccgaccgcgcctccgcctacggcgcttgacggacgaagagtccgaggaggctggcaacgtcgtggagaggttggcagcgtcgctggcggcgaagattgcagatgcgccagactgggagacggcggagggctacatcacggccctaccgtacgccctctacgacaagctgcagccgtactcccagtcccagcaccaacctccacgtcaacagcagcagcagcagcggcaacgcccacggcagcagcagcaaacacggcagcgtcgacagcggagatgcaagcgcggcggtggcagccaacacaggcagcggaagacgcgccgccgacggcccccacgggtgacacgccaccaccgcgagcaccggatcgatgaagccctcgacgacctccacgcgctcgagagcaggcgccctcaggacaggacggccatcagcaaggccaggcgtcgagtcggtcgcatccgctccgcccttgaccagcaccaattgcgccaccgcttcgacaccgacgagaaggcctgcgtggacggcatcctggccgccgcgcgcgacaaggacagggcggcatcagtgacgacaacagcgcaaacagcggctccgcctcattctgcaccagcttcagctccttcgtcggcggtggacgacggaatctgcccgattccgggagacttgctccatgccttcttcacagacgtgaacacgccgcgcacggagttcgacgccgactcgcccatcggagcccgctttcgggaggcgcttgctcagctgcccgctgccatcgctgccacggagctactcatggagccgccgtcgccggacgaggttgaggaccagttgcaacgtgtacggggtacgtccagccccggcttggacggagtggggtacgacgtctacaagaccttcacacagcaactcctaccggccctgcacgccgctttctccaggtgttggactgatcagcgcgtcccacagagctggaagctcggagtcgtgcggctcctgttcaagaaaggagatcggcaggaccccgccaactggaggccgatctgcctccagcaagccgtctacaagctgtacgccggtatcctggcccaccggttcacacgctggctcgacgccaacacccggcacgctgacgcacagaagggattccgcgcggttaacggctgcggggaacacaatttcctcgcagccacgctgacggacaacgcccgccgccgacgccgcgagctgcacgtggtctggtacgacatcaagaacgcgttcggcagtgtgccccacgaactgctgtgggaggtgctgaggcgcatgggagtgccggcgcagttcatcgcgtgctgccaagggatctacgacgcggcagctttcacggtcgggaacgcagcagacggcacgacggccccaattcagctgcgcttgggcgtgtttcagggatgtcccttgagcccccacctcttcacggcggtgatcagcccactcctccacgcactcaagcggctccctggcacgggggtacagctctcagccgtcgaccggccaggtgcgtcagcatatgccgacgacctcaaggtcttcagtgacaccaaggatggcatcacgcggcagcaccagctcgtcaccgacttcctgcgctggacaggcatggtggcaaacccgtccaagtgcagcaccatgtctgtccagagggacaaccgcggcgttttgaagaccgccaacctcacgctccagctggacggcgcccaaatcccagcactcgggatgaccgaggcgtacgcgtacctgggcataggcgacggattcgaccacgtacgccgccgcgtcgagttggcccccaagctccgcgaactgaaggcagacacgacggcgctgatgcagtcggggctggcgccgtggcaagttgtgaaggccctcaaggtttacatctacccacgcgtggaatatgccctccgccacctccgaccgtttcagcagcagctccaaggctttgaccgacacctcgcgcgcgggctgcgtcaccttctccgcctgccaacatcagccaccaccgagttcctgtatgcaccaacgtcgcgaggaggtttggggctgctaccgcttacagaggttcacggtgcccttcagattgcgcacgcctggcagaccctgcactcgccggaccccgccatccgccgcattgcccgcgtgcagcttcgccaagtcgccgacgcccggcaccgcttggacgccgagcactggaaggagcggggggaggagctgtgcgagcggctgctaaactcgcagctcgggacatcggcccacgcgcctcccaaacgacgcaattgcgacatcggctcgctgtgggtcgatgtccagcgccacctccgctctctcggcctacagctacagacagcccccgcggacacgcacactggcgcaccagctcagcctctccagcttcgcgtgccgcaccacgacaagtggctgacgcacaaggacgtgctgcggcacgtgaagctgcacatcaagaataaccactggcaccgctggacatccatgcgggaccaagggaagacggcccgcgcccacggcggtgaaggcagcggcttccttacgcagccgcgaggcatgtgggaagccgactaccggttcgcggtggcgggtcgtcttaaccaagtggacacgtacagcgtactgaagcgccggcgcctgcgctcgcacgacagatgccgccagccaggatgccatcgtgccgaaacactggctcacgtgctaaaccactgtcccggcacgatggacgcggtccgagggcggcacgacggagcgctcaagcgcatcgagcgtgagctccacgcgtcggccacggaccgccgggaccgcgtcgagctccgagtgaaccagaccgtgccgtcactcgccggccccgcgttacggcccgatctccagctctacaaccacaccaagaagacggtggcggtggtcgacctggccgtggcgtttgaggagcaggcgagtgacgacgcgagcagctcggcgctgtcccttatcgccagccacaagcgagccaagtacgaccgcatcaagcgacacctcgagcgccaaggatggaaggtacacctctcggcgctcgtgtacgggtcgcttggggcggtcgctagtggcaactaccaggtgtacaccacacacctggggctactcaagcgcgatgcaaagcggctggaccggcagctgtctgtcgaatgcatccagtccagccgccgcatctggaatctacactgcagccagcaccggactcgccaacaccaggcgaggcccagccaaggaccaagaggcagccgggcgacggagaccggggggactccgtcccagacaagccgccgctaggcggaaaccaggcccaagacggccgacagggccccacccaggtagggaaccgccctagaaacccatttcggtggtcgactcgaaggccttacctattttttccttagacattcaattaggtagcgaccaaattacaaatttggtaacgagtaagccaaatggtaatacacaaaacttttctgttctaatcagtgtgaaaactggttttcgccttttggcggactttttcactcgcatttttgggcaatcgtctgcggctagcttgctagcggcggacgagcggtctccgggggcgttcacctttcccccgcgaggccaactacaccgatcttctctacacttttctaattcgcctccgtcttcggtcttcggctgtcggatttttttctttttgaccaatcagagcgcgccatgcgactcttctggccaatcagagaccgggccctgtcctcggacagcgaggcctccacggccagccaatcaagtctcggcagcgacgcgtctttctatagcgcagctgacgaggccgatctggcggcccccgattggtccgactttcggccaatcagcgacgacgagggggcaggggtttacacttttgcccccgtttcgacttcaacttcaggccaaaatggcgatttcgaccctccacgcgccgtgccactgctcggcaccggcggcgattcagcgggtgcaacttcgggcacgtgtgcaacacatgcagcgcccattgcacgccaagcggcatcgcgggacgacgcctcggccgctcaagcgcagccccgcccttccagcacgacctcgcgccgtttggcggatcgccatcaagacgtgcgagagccaggcggggtcgggcaaaatatacttactctaagtatgcccgaatccctgccctctcaggctgaacgcggccccatacttgatctaagtatgggagggatccctggcctctcaggctgtacgcgagacccgtacggccgaatcccctggcctctcagcctgtacgcggggc

SEQ ID NO: 1076 - DNA, 5331 bp, Phytophthora ramorum
tcaagccccgccgccaagcccagctgcggctgttgccgcccctccagcagcagcagtcgcagctgaacctacagcccctcctgctgatcgcgccgccgtggagccccgcgcgcgcgccgagccgccccaagaacaagcacccccagctagcgcgcgcgtggagcccatgtcgggcgacgtggtcagcagcgacggcagcagcaggacgacggacgcgagcggcgacggcgacgacggcgcaggcagcagcgatgcagcaggcgacgtcggcgtcgtcgccatggacgttgaccaaggtgcccgccgacagcagccgccatggcagcgcgtcggcggcaagcgtcgacgtctcaacgacgtcgacgacgaagacacccgcgagctggccgagctcctgctcgaggaggaggacgaggctggggaccacgctccagcgcctaggctatccgcggccagcgctcgcccggcctccgtcctctccgtgtacgcgcacaatgcgcagcgcttccagtgcacgctgtgcacgtacacggccgccagcttcgcgtcgctcaagcgacaccgggactcccggcaccgccgcaccgccttcctcgaccggttctcggcgggatgtgcgtgcggtgcgcccttcgcgtcgaggctggctgctgcgaaccacgcacacgcgtgcgccagcctcaaccgcaccttatcggtagcggctacgccggcagcaggggaactgagccccactgctggtgcagccaacgccaccgtcaaggcggccaccgtcacgcccgactccccccgccaagaccccccggagctcgcagcgtcccccccgctagcgagctcccccgacgttgctgtgcaggccgccgacatgcaggccccgactcgttgggacccgcccctcccccgcacgctggtggcgacacgggtcgcctcccgcctcaccgacctgacaccgccgcggtggggaccgccgctgcctcgagccacggtggtgtctcgcatcgcggcgagactcgaggccgcaccaacgccccgttggggccctccacttccacgcgtcgtggttgcgtccmggatcgccgaacgcttagctccgcccgagctggcagctgacgacgagaccaaggacggcgaggaagaccagagctttacggaacctgtggctgccgcccggtcmgakggcggcgaggacgcgaacggcgagtggctgcttcgcttcgacggcgcctgccgagccaacccaggccccggcggtgcgggcgcagcgctgttcaagcccagcggcccggtggtgtggacctgctcccactatatgccgagcagcagcgagaccaacaacacggccgagtacacggctctgctgctcggcatgcgggctgcggcggaccatggcgctacgcgcgtgcacgtcgaaggtgacagcaccctggtgatccagcaagtgcggggcatcttcgctacccgtagcacccggctccgtggactgcgcaagagcgtgaaggcggagatggcgcggatggagcatgtcacgctccaccacatcgaccgccaagccaacggccatgccgaccgcctcgccaacgccgccctcgaccgccgcaagaccaagctggagtgcggactccaccctgacggccaaggctgctccagcaccgccgcgacgacggcggtcccctctgtggtgccggaccggcctccctcgtcaaccgctgccgcgccaacgccaagcgccgaacccgacgagaccgagcagggcgacatcgacgacggcgaggtctacgccgccatgtgcattggcccggactccataccggagcgccgaccacgcctccgcctacggcagctgtccgagaccgaggaggaggaggcgggtgccattgtggagaggctggcggcaacgttggcgggcaagatcacggacgcgagtgactgggcgacggcggagggctacatcactgccctcccctacactctatacgacaaactgcagccgttcgcccagcaccgccaccagcctcgcccacagcaccggcagcaaccccagcgcgacccacccctcggcacccacgacggggaccacggccagccgagcaccagccgcagccgtcgccgtcgccgccgcgccaaggatcgcttacgccgacgcccaccgcgtattacccgccaccaccgtgagcaccgcctcgacgaggctctggacgacctgcgggcggtggagcacgccagtccccacgaccggccggccgtcgctcgggcccggcggcgcgttggccgcgtcaactccgccattgcccagcaacagctgcgacacaagtttgacaaggacgagaaggcgtgcgtggatggaatcttggccgcggcccgagcttctcgcgggttagcaaccccatcggcctcagcctcgaggcatccaccgccggtaccctccaccgctgctgatgacggctcctgccccatccccagcgatgagctccacgccttcttcacggccgtgaacacgccggcgggcaccttcgagcccatggcaccagtgggtgccccgttccgctccgccgtcgcccacctccccgccgcgacatcgcagcctgagttgctctcggacgcgccgaccacggacgacatcgaggaccaactgcagcgtgcccgtggcagctccagccctggcctggacggcgtggggtacgacatttacaaggcgttcgcggcccagctcctgccggccctgcacgcagcattcgcgtgctgctggcgccacaagcaagtcccgcagagctggaaggtgggggtggtgcgcctcctgttcaagaagggggagcgaaccgagccggcgaactggcgcccgatctgcctgcagcaggcaatctacaagctgtacgccggggtgctagctcgccgactcacccgctggctggacgccaacggccgccacgcagacacgcagaagggattccgggcgatgaacggctgcggggaacacaatttcctcgcagccacgctggtcgaccaggcccgccgcaagcgacgagagctccacgtcgtgtggtacgacttcgccaacgccttcggcagcgtgccacatgacctgctgtgggaggcgctcgagcggcagggcgtccccagccccttcattgcttgctgccggggcctctacgcggatgccgtcttcacagtcggcaacgcagcggacggcaccacggcaccgatcgcgctacgggtgggggtcttccagggatgtccgctgagcccccacctcttcacggccgcgatcgccccgctgctccacgcgctcaagcgcttaccagacacgggcgtacagctgtctcgtgtcgactgcctcggtgcctccgcgtacgcggacgacctcaagatattcagcggcaccgagggcgggaccaagagacagcacgcgctcgtggcggacttcctgcgctggaccggcatgcgcgcgaatccggcgaagtgctgcaccatgtcggtccagcgcgacacacgtggagtgctcaaggcctgcaacctcggactgcagctggatggcgccccgatccccgcgctgaccatgagcgcctcgtacgcctacctggggatcggggatggcttcgaccatgtgcgccgccgcatcgagctcgcgcccaaactccaggagctcaagcacgatgcgacggcgctgctgcagtccggactggccccatggcaggtagtgaaggcggtgaaggtgtacctctaccctcgggtggagtacgcccttcgccaccttcgccccttccaccagcagctggagggcttcgacagacacctcgtgcgcggcctccgccacctcctccgcctgcccgccaacgccacgacggcattcttctacgcgccggtgtcgcgcggcgggctgggcctgctgcccctgacggagctgcacgcggcgctacaagtcgcgcacggatggcagatgctgaactcgaaggaccctgccatccgacgcatcgcgcgcgtgcagctccggcaaatcgccgacgcgcgccaccggatcgacgctcaagcgtggcaagaccgggaggaagagctggcgcagctcctcctgaactcgcagctcggggcgtccaccggcgcacccccgaagcgccgcaacggcgacatcggctcgctctgggtggacgtccagcgccacctccgccatctcagcctcaagctggagaccgcaccggcgtgtgcggagaccggcaccgccgcggccatgctgcagcttcgcgtgccgcaccacgacaagtggctagaccacaagactgtgctgcggcacgtgaagctgcactacaagaacaagcactgggccaggtgggcggccatgmgsgaccaaggcaagacggcacgcacgcatgggggcgcggggagcggcttcctcacccggccacgaggcatgtgggaagccgactaccgcttcgcggtggccgcccgcctgaaccagctcgacacgcacagcgtsctgaagcgccggcgcctccggsmscacgaccgctgtcgacagccgggctgcacccagggsggagacgctggcgcacgtgctcaaccactgcgccggcaccatggacgcggtccgcggccgccacgacgacgccctcaagcacatcgagcgcgcgctgcacgcgtcgtcgccgggcggccaggaccgcgtcgagctccgggtcaaccagacggtgccgtcgctcgccggccccgcgctacggcccgacctccagctgtacaaccacaccaagaagacggtggcggtggtcgacctggccgtggcgttcgaggagcaggcgagcgacgacccggagagctcggcgctggcacgcatcgccgcacacaagcgcgcgaagtatgccggcgtcaagcgacacctcgagcgccaagggtggaaggtccacctctcggcgctcgtgtacggctcgctcggcgcggtgccggccggcaaccacaaggtgcttactgagcaccttgggttgctcaagcgtgatgcgaagcggctggaccggcagctctcggtggcgtgcatccagtccagccgccgcatctggaacctgcactgcagccagcaccgcgcgcgccagcaccaagcaccagggggaagtcgggcggcggagaccggggggactccgccgcgcaccggccgccgctagacggcacacaggcccacagcggccgacagggccacacccaggtagggaaccgccctcaaaccccgccggtacattatggtccgacacctatgaggtgcaacctgtacacaagttacacaccacatagcgactaccaggtatttactacctggaagccaaggattaaccggtcggtaatacacataacttt

SEQ ID NO: 1077 - DNA, 5919 bp, Pythium ultimum
tgactggtgtttgatcacgatcaatgaggtgattaacatgagccggagcaggccccttacacgctggtgctgtaatggttcaggaatgctcttatgagtaactccacagtataatttttgttagcgggggtgagcgcgtgcgccgcccccacctttctcttttcgtttgtatttggttcctctggagcgacttccgtggcttttgtcgcgcgctatcgcgcccggcatgaggatcgtcgctcctgacgccatgtgcgccagtatatcggagccccgtgctccgcttgggtgtgtgttccgccacgacgccacgcgatttgcgtgcacggcatgcgctggcgacttccgctcagtgcgcgaactcgcggtgcatcgtcgacgtgcgcaccggtctctggccttccaggactggtatgagtcgtcgtgcgcgtgcagagcgctcttcaccgcccgtctcgacgcgttcgttcattcgagccgttgcgaccacaatgcgaaccaatcagcgaacgccgtcccctcgtccgccgcctcgacaacgagagcggacgcggatgcgacggccccccctcccgctatctctcttccgcggacgggcttcccccgcccctgtcctagttgcgccgctctccttctggatgcggcaacttggacgacccacgtgcacgcgtgcgctgccgccagtgcgacggcgttgatccagcgtcatctacacgccgttcctcccgtatcgacagcaaccgatctcaacggcgatgatagccaacctccagacccgcgtgccaacatccaacagcttccagccatccattcgacaacgacaacgacaacgacaacgacgacgacccgctgctcgacgacgtgctcatggactacgacgactcggagtttttcgacgccatctgcattccagacgaagacgctgacgtgctcgacgatggtgacgaaggtgacgaaggtggtaacgacgacgagtcgtccgagccactgcctctagcgatcacgaacgctccaagcgctcccttgcacgcgaccatgctctgcggcacagttacacagccatggctcctgcgcttcgacggcgcgtgccgacgcaacccaggacccgccggcgccggcgccacgctcacgcggcccaatggtatcatcctatggacgcactacaggtatatcccggacaagacggcgaccaacaacgttgccgagtacgaagcgctgcttgacgggctgcgctgcgcggcgcaccacggcgtcaaacatctgcgtattgaaggtgactccaacctcgtcatcgagcaagtcaaaggcatcttcgcgtgctccacatcgctgcgcccgcgccgcgaccaagtccgcgagatcctgcgccacttcgagacctacagcttccgccacatcgaccgcgcacttaatcgacaagccgaccgcctggccaaccaggcactcgatctcctcaagacggtctccgtgtgcgcgctctctcaaactcgcgtccaagacgataccggtgccgcacatgggtgctggcactggacgccgccagatgcgtcgccaaccgacgatgcatccacgtcgatactcacgcaggacgttccagtccccatggatatcgatgattacgaccccgacgagcccatgaatgcggccgatgatccagtcagcattaatgctgaacgagaaggtggtactgtctacccagtgcttcgcctcggtcccaacgtcgtccccgaacgacaaaagaggttgcaaatcccgtggctcccgccgcgtgagatgcaaaaactcgaaaagaagatcgaagtgctgggggagacttttgcgtcgcgcattcgtgacgcgcccgattggttctctgcagaaggctacatcacggctctaacgtccgagcttgcaacgctcattcgccaatcaacggcggcgacgacgggaccgaatgcagcacgaccctgcgagcgcaccatcagcaaggaaaagcggcgcgcgcgaagaacgacaccgttacaacgcgcgctcgcggaggcaaagcacgagctccagatcattcagcctgatgcctcgcgcaagagcgtgaggaaggctgcacgacgagtcaaacggatctcccaagcgcagcagcgccacgacctgcgtcgcctcttctcgaccaacgagcgtcgttgtgtcgagaaaatccttcgtgatcccccagtggggccatcgagtaccagctccagcttgccagccaccgacgatgaccgctgtaccattgacccagccgacctgttcgcctacttccagacgcaagccacggccccaacgaacttcgactttgacgacgaaggcggcgaactgttccgctcggtgctcgacgaactgccgcgcgccgaccaagaggttcaccttcttgaggacgagatcactcgggacgagatcgaagaccagctctcgcgcatctcgaaatcgacggcaccgggactcgacggcatcacgaacgctgtgtacgtgcgcttcaagctacagctgcttgatgcgctacaagctgcattcaatgcatgttggcgatacaatcgtgttcccagcatgtggaaggcggcgtttgtgcgtctgatctacaaaaagggcaatcgcgctgtgccaagcaattggcggccgatctgcctacagcagacagtgtacaaactatacacagccatcctcgcctcgcgactgcagagatggatggacgcgaacgcgcggttcacgatgtcgcaaaaaggatttagagcgtttaacggttgccacgaacacaattttgtggctacctgtctacacgaccaaacacgacgccttcgaaagaagcttgcgatcgtgtggtatgatctccggaacgcattcggctcgctcccgcatgagtatttgtggcgagtactggcgcgccttggcatgccaccgcagtttgtcgcaagagtgaggcagctgtacgcggatgcaagcttcaccgtggaatcccgtgacgggacgacagaccccgtccagctggagcgtggcgtatatcaagggtgtcctctgagtccatacttgtttatcgccgcactcattccgctggtgcgcgcactccacaagctcaaagaccagcacggcatcgtgctggctcccggcgtcaccgactgcgtctcggcttatgccgacgacatcaagattttcgctcgatcgggaaccggcgccaaagccctccacgagatcgtggtgcgatttctgtcctggacgaacatggcagcgaacccggccaagtgcgcgctgatggtgaccgatggcgctcgtggcggtgacgacaccgatgcgagcatgacgctatctatcgaaggtgagacgatcccacgcctcaccggcaaagaaggctacgtgtatctcggagtggaagatgggctcgcgcatgagcgcagagcaacgtgcctgcgcgactcgctcaaggcagcgagcgcggatgtcgtccgcctgcttcgcagcgacctcgcaccttggcaaatcgtgcgtgcgatcaagtcgcacgtgctctcgcgtttcgattatgtactccgacacttgcgcccgttccttagtctctttgacggcttcgacaagatgctggtgcgcggaatcaagaggctgtgccagctgccgcaaacagccacgtccgagtttttgttctcgcccacctcggcgggtggcctcggcttcctgccactgaaggagctttttgcggcgctgcagattgtgcacgcacttcaaatgctgcactcgaaggacgccaacgtccgtgccattgcacggcaccaagcgctgcaagtggtgcgtaagcgctacgcgctgcagtctgaccattggagcgaccgcgaagaggaacttctcgaagagttctttaacggcacgctggagcgctcgcccttcgccctcgcaaagaaagtgtcaggggacatcgcgtcactctggacggatgtacgagtgaatctcaccaagtacggactcaaattcggcgaggcgcacggacggcgactgcagccgctcgtcagtcacactgacaagcagcttgcacctcaacaatgggctagtgcaatcaagacgcacatgcgcctgcgccacctcaagcgatggaccaccctggtcgaccagggtaagacagcccggatgcatgagcgcatcggaagtgcgtttctgacaaggccgtctggagtgtacgacgccagctatgcgttcgcggttcgagcaagactaaaccaagtcgatacgcgcagcgcattgaagcgcaagcgcatcgtgaacaatagccgctgccgtgtgagtggatgcagcgagctggaaacgctcgcccacgtactgaatcactgccgattcgggtcagactcgatacgagcacgacacgcagagacactcttgctgatcaagacgaccatggaacgtgagctcacgcggccagggcggcagcaccagcgcctcctggtcgacgcgacagtacccgaagctcgtgatcccgtaccaagtaatgacgctgctgagagcaacattggcgcaatggcacccagcatctcccacttgcgccccgacattcaactctacgacaacaagacaatggaagccgtgatcatcgacctcgcggttgcgttcgaagaccagtcaacggacgacgccgcatccagttccagtttcgcgcgcgtcaagggtgtgaagacaaagaaatatgaggtaatcaagcaatttctggaatacaaaggctacactgtgcatgtagcagcgctagtctatggttcactaggctccgttgacaccggcaactttgccgtgtatacggaacgtctcggtctccgcaagggcgcagtgcggcgactggagtgctcgctctcggcgcgccacatcaacttcgcgcaccgtatgtggcgacgccacgcgatcgcccacacgaccggtttgcgccttatcggcacgaacagcgtgcaacagcagggtgtgcagcgcgccccggcagagaagcaacaacatcagcgaccagtgcagcgacccagccgcgcgcaagctccacgtgatcagccatcgcagcaacagcagtcccagcagtcgttccagcagcagtcccagcagtcccagcagtcccagcagtcccagcagtcccagcagtcgcgtcaacgccacgccccaactcctaccccagtcccagtcccagtcccagttccagtatcgacaccgacactaacaccgacaccgacaccgacacgccggcccaagccggctccgtcctcgactcaaccccagcaaggagctccagcacagcgacgacaacaacgagagcagaaaaagcaacctgcgtgccgccgtcgacacgcaacggcagtgagagagacaccgccagcagctccgacagcagctcggacagcaactccgacagcgagaccgacagcgacaacgagatcaacatcgacaacgagatcaacagcgacagcgacatcgacaacgagatcatcagcaccgacatcgagaccatcagcaccgagaccgagatcatcagcaccgagaccgagatcatcagcaccgacaacgagatcagcagctccgacaacgagatcagctgcaccgacagcgatagcgacaaccagcgtttacaaaagtcgacgcacgaccaacgccatctctggcgcaacgacgcgacgcagtgcgtcatccaagcgtgcgccaatgcagccccgaactgcattgacgccaacacaacaacaacaacgacagtaagcggggggtccagaccccacaagagagaagcaggaatcatggtccgcatggaccagtagggcacgctccacaaaggttatcgccctcaaacccatcacacgaaggatctaaaaagaaagcaacaatcgaaatagtaaatagtaaatagcttagaaaggtcaacatgcgaaatgcatgaggaacgtaagatggtaatacatttttata

SEQ ID NO: 1078 - DNA, 7103 bp, Phytophthora infestans
gtacggccgaatccctggcctctcagcctgtacgcggggctatacttggtctaagtatgccccggtcgctggcctctgagcccgtacacagctcggcctcgcggctgccttcccaggcgccgccgacttcgcgctctggcgcggcccacacgccgccgccgagcctccaagcgcgcccgttggcttccgcagacgcagggctcgcggcgacggccctcgccagcccccaagaccccccctacgatgtggcaccacccggcagggcggccggcaggctgcccgactcggtatcgccgggtgctacactctcagccgccacagctcgggccttggcggtccgccattggcccttggagctcgacagcgacagcagcgacgacgaggacgctcaagacccccacgccgccgccccaggaccccccgcagacgtcgcgagtgtgcttgccccacccggcagggcaggcagcatgctcgccgacccagcagcgctggcagccggtctggctcgcgctccgccgcccccatcggcaccccaggacccaagccccgccctccctgctggccccgccggccagaaccctcgcgccgccgccccagcccgtgttgaagtccacacagtcgtggcaccacccggcagggcgggcggcatgctgcccgacccggggttggttgactcaagcccagcagcggctaccgcagctactccagctccggtagctgctactgctacaactgctcgcgtcgccgtggagcaccacgcgcacgctgagccgaaccaagaacatctaccgatggctcgcgtgctcgtggagcccatgcaggtcgacgagtgcagcagctgcgaccgcagcactttgacagccgacgacgggagcggtgacgacgttgcagccccaagctccatgctcagcaacgacgtcgccgcccccatggacgttgactccggcaccagttgccctccaacgttgcagcagccgctccagcgaccgcgtgcgctgcacgtaggcagcaagcgccgccgactcaacgcagatgacggtgaagaagctcaccagctgcaagaagaggaggaggctggcattcatgccccagcgctcaggctatccgcggccagcgctcaaccggcctccgtccttgccgtgtacacgcacaacgcgtcgcggttcgactgcacgctgtgcgcgtacacggccggcagcttcgcatcactgaagacgcacaggaactctcggcaccgccgcaccgcattcctcgaccgattctcggcgggttgcgcgtgtggcgtgcccttcgcctcgaggctggctgcagcaagacacgcgcaagcgtgcgccagcctctcgagcgcaccattggccgaggcttcgtcggcagcaggagcatcaagccacactgtcgacggagccgactccaccgtctcagccgcgggtcacgctgagcccgacctgccccgccacaacgccacggagctcacagcgtcccccccgctggtgagctccaccgatgttgaagtgcaggcaacagagaccgaggccaccgagaaccgctggggcactccacttccgcgcgtgctggtcgcgtctaggatcgccgggcgcctcgctcaggtgccacccccacgctggggccccccgctaccgcgcaccaccatcgcgggccgcattgcgacgaggctcgccgccacacctgccccccgctggagcccaccgcttccacgaagcctggttgcgtcacgcatcgccggccgcctgctacccgctctgccagacgcgcctgcatgcgaggacgaggccaaggacagcgacgaaatggactgggaggcgagcgagccgcacgtcgaagcgccagggccggtcgacgaggagaccatcgacgacgccgacggcgagtggctcctgcgctttgacggtgcctgccgtgccaacccaggcccaggcggcgccggcgcagctctcttcaagccaagcggtcccgtagtgtggacttgttcccactacgacccgagcaccacggcaacgaacaacacagcagagtacactgcgttgcttctcggggccagggccgccgccgaccacggcgtcacgaagctgcgcgtcgagggcgacagcacgctggtcatccagcaagtgcggggcatcttcgcgacgagaagcacgcggctccgagcactgcgcaacaaggtcaagctcgagctcgcgcgcgtggggagcttctcgctccaccacatcgaccggcaggcgaacggtcacgccgaccgccttgccaacgccggcctcgaccgacgccgcacccagctcgagtgcagtgtgcaccccgatggtaggggctgcaccaacacctccgtagcgaccgcagcgcctacagcttctgcagcaccctcgaccccaacccggcctcctgcaactacggccgctccgtttcacagcgaccaaggccacatcgacgaggacgacgaacgtcgtgccgacatcgacgacggtgaaatctacgccccaatgacgctcgggccagacgaagtgcctgctcggcgaccgcgcctccgactccgccaactcagcgacgaagaactcgaggccgctggtgccatcgtggaaaggctcagcgcatcgttgtcagccaagatcaccgacgcagaagactgggggacggcagaaggctacattacggccctgcctcacctgctgtacgacaagctcctaccgtactcgcggacagcgccccgtcatcagcggccaccccggccatcgcgcaaccagcaagaccacccgcagccgcgacgcgaccaaccgcagcgcaacgtggacgaacagcagcatgcggagtcacagcagggtgaagaccagcgacagcagcagccgccgacgcgccgccgacgtcggcgagggaagcgtagaggccgccgacagcgacgacaccctcgccagccaggacagagtaccagagcctcccagcaaagccggcagcgccgaccccgacccccgcgcgttacccgccaccaccgcgagcaccgcatcgacgaggcgttggatgagctccatacactggagcgggcgcggccacaggaccgatcggcgattgacaaggcgagacggcgcgtcggacgtgtccgcggggccatcaaccaacacctgctgcgccaccggtttgacaccgacgagaaggcgtgcgtggcggacatcttggagaaagcgcacgcggcgcgagcggcacgtacggcacaggcggcgggcgcagcaacgtctacaggaggagcagcgacagcaccaacacagcaagcagccacgtcagcccttggtgatgccgacgacggaacctgccccatcctggccgacgagctctggcagtacttcaccggcaccaacacgccgcgctgggagttcaaccccgcgacacccgtcggcgaggcgttccgtacggcgatggcaaggcttcctccggcgacgaggctccgcgaactgctgacagaagccccgactgcggacgaaatcgagacccagctacagcacgtgcggggatcctcgagcccaggactcgatggcatcggctacgacgtctaccagcgcttcgcacagcaactgctcccggtgctcaccgcttcgttcaagcgatgctggacagccaagatggtgccacagagctggcaggtgggggtcgtgcgactgctgtacaagaagggcgcgcatgacgacccggcaaactggcggcccatttgcctccagcaagccatctacaagctttacacaggtgtacttgctcggcgactcgtgcggtggctggacgtgaacgacaggcacgcaccaggacagaaggggttcagggcagtgaacggctgcggggagcacaacttcctcgcagccacgctcatcgaccaagcacgtcgcaagcgccgatccctatacgaggtatggtacgacttcaggaacgccttcggcagcgtgccattccagctgctgtgggactcgctgcagcgcctcggcgctcccgcagacttcatcgacatgtgcaaggggctgtaccaccaggccgccttcgtcatcgggaacgccgccgacggaccgacagcagcaatccggcagcaggttggcgtcttccaagggtgcccactgagcccccagctcttcaacgtcgcgatcagcccgctgctcttcgcgctccgcaggctgccggagaccggggtgcagctgtccggcgacgatcgtgttggagtttcggcttatgcggacgacctcaagaccttcagcagcaccaaggcgggcgccaccaagcaacacgagctcgtcgccgcgttcctggcttggactggcatgaaagccaacgcagccaagtgcagcagcatgggcgtacggcgcaacagcaacggcgcgacagaggcggacaatctggacctcgcgctcgacggcactccgatccccagcatgactcacatgcaatcgtacacctacctggggatcggagacggtttcgaccatgtgcaccgccgcatcgagctcgcgcccaagctgaagacgctcaagcaggacacgacggcgctactcgagtccggcctcgcgccttggcaggtggtgaaggccgtgaaggtttacctttaccctcgtgtcgagtacgcgcttcggcatctgagacccgaagaccagctgctggagagcttcgaccttcacctccgcgccggccttcgccacctgctccgcctgcccaagaacgccaacaacgacttcttctactcgccggtctcgcgcggtggcttgggactcctgccgctggtggagctgcacgcggcgctacaaatcgcgcacgggtggcagatgcttaactcgacggacccagccacccgacgcatcgcgcgcgagcagctccaccagattgcggatgcaaggcaccgccttgacaaggcacactggaaagagcgtggcgatgagctctgccagctcttccttaacttggacctcgggacgtcggcccacgcaccgcccaaacgccgcaactgcgacatcggctcgctgtgggtcgacgtccgcaagaacctgcaggcctttgggctcaagctcgagaccgccccggccgacgctgagtccggcacacccgccctgccgctgcagcttcgcgtgccacaccacgagaagtggttgacgcaccgcgacgtgctgcggcacgtgaagcagcacctgaagaacaaacattggcgggcgtggtgtgccttccaagaccaaggcaggacggcacgggcacacggtggggtcggcagcagcttcatcacccgcccccgtggcatgtgggagagcgactaccgctttgcggtggccgctcgcctcaatatggtggacacgagtgccactctcgcgcgccgacgcctccgcgcccatgaccgctgccgctacccgggctgccgctggaaggagtcactggagcacgtgctcaaccactgtccgggcacgatggacgccgtgcgtggccgccacgacggtgtgctccgagagattgagcacgcgctccgtgcaccatcgggagcacgcagagagctgcgcgtgaaccagacggttccgggcctacccggccccgcactacgccccgacatccaggtctacaaccacgaccaacgcacggtcgcagtggtggacctggcggtggccttcgacaggcaggaccgcgacgacccagagacctcgggcctggccaaagccgcggcggagaagaaggccaagtacactggcatccagcgacacctcgagcgccaagggtggaaggtccacctttccgcgctcgtctacgggtcactgggctcggtggcccccaacaactacaaagtctacacggagcacctggggctcctcaagcgtgacgccaagcggctggaccggacgctgtcggtcgcgtgcatccagtccagccgccgcatctggaacctgcactgcgccaagcatcgggcgcggcagcaccagacgccatcccagtcaaggggcaggcgggtgacggagaccgggggggctccgtcgcgcaccgatcgccgctagacggcaaagttctggcccgcgtaggccgaaagggccccgcccaggtagggtaacgccctcgggaaaaccattctggtgtttggctgtttttcaacagtcgaacttcaactcggagcatatcagatacacttactcacacatttagatatcagatagggaacctttattagggagataacgggtacaccggatggtaaatatacaaaaccttctctgttctaatcagtgtgaaaactggttttcgccttttggcggactttttcactcgcatttttgggcaatcgtctgcggctagcttgctagcggcggacgagcggtctccgggggcgttcacctttcccccgcgaggccaactacaccgatcttctctacacttttctaattcgcctccgtcttcggtcttcggttgtcgggcttttttctttttgaccaatcagagcgcgccatgcgactcttctggccaatcagagaccgggccctgtcctcggacagcgaggcctccacggccagccaatcaagtctcggcagcgacgcgtctttctatagcgcagctgacgaggccgatctggcggcccccgattggtccgactttcggccaatcagcgacgacgagggggcaggggtttacacttttgcccccgtttcggcttcaacttcaggccaaaatggcgatttggaccctccacgcgccgtgccactgctcggcaccggcggcgattcagcgggtgcaacttcgggcacgtgtgcaacacatgcagcgcccattgcacgccaagcggcatcgcgggacgacgcctcggccgctcaagcgcagccccgcccttccagcacgacctcgcgccgtttggcggatcgccatcaagacgtgcgagagccaggcggggtcgggcaaaatatacttactctaagtatgcccgaatccctgccctctcaggctgtacgcggccccatacttgacctaagtatgggaggatccctggcctctcaggctgtacgcgrggaccaagtacagccgaatccctggcctctcagcctgtacgcggggctatacttggtctaagtatgccccggtcgctggcctctgagcccgtacgc

SEQ ID NO: 1079 - DNA, 5289 bp, Phytophthora ramorum
tgcgcggcagaccaagacgcgcagccaacaacagaccgtgcagcgtgcgggtggaaagcgccgccgcctgaacgctggtgacgatgaagaccagcgagagctggccgagctcctgctcgtggacgaggacaaggctggcgccgaacaccccgcgctcaggctgcccacggccagcgctcatccggcctccgtcctctccgtgtacgcgcacgctgcaactcgcttcgactgcacgctgtgcacgtacacggctgccagcctcgcttcgctcaagcgccaccgctcgtctcggcaccgacgcacggccttcctcgacaagttcttggcgggctgcgcgtgcggcacgcccttcgcatcgaggttggccgcagccagacacgcgcaagcgtgcgccaacctctgcaccacctcggcgacgacttcgacggcagcaaaggcatcaagccccactgctgccggaggcagacccaccgtccgtgcagtggtcaccgccgcgcccgacctgccccgccagtatccctcggagctcgttgcgtcccccccgcagccgagctccaccaacgttgcaatgcaggaccaggtcgacgcagagcagcaggcgcgaaatcgctggggcccaccgctccctcgaccgctggtggcctcccgggtcgcagcccgactcggcgaggtaccgccgccgcgatggggcccaccacttccgcgaggggtggtggtgtcccgtattgcggcccggctggaagccgtcccagtcccacgcgggggacccccgctcccacgcagcttcgtcgcgaccaggatcgcagaccgcctcgctcccccctccccggacctgtcgctgctggacgaggagatgaaggagagcgagccgcctgacccgacgcaccactcagcggacgaggattccacggacgcagagacggcggacgcagtgatggagcccgcgttcgtcagcgacccacccacggcgacaccccgggagtggcgcctccaattcgatggagcttgccgtggcgggcccaaccccggtggtgctggcgcactgctctacaaccccgagggtgctgtcgtgtggacgggttcgcactacatgccgggcgccaaggagacgaacaactcggccgagtacacggccctcctgatcggcgcccgcgcagcagcagaccacggtgcacgacagctgcgcatcgagggcgacagcctgctggtcattcgtcaagtcaagggattgtacgccaccaagagcactcggctgcgacagctccggaacgccgttcgccacgagctggctcgggtggggcagcactcgctccaccacatcgaccggcaaggcaacgcgttcgcggaccgcctcgccaaccgggcgctcgacctgaagagcgacaaagtcgagtgcaaggaacaccccgtggccggcgcgtgcacgacatgcatgggttcgccctcggcgggcccgccagcgacaccgccccctaccactgccgacatcgagatggcggacgcggggagcgacgacgagctccgagcagacatcgacgacggtgaagtgtatgctccgatgcgcttagagcccggcgtgatcccgacccgccgctcgcgcctccgccttcgccagctgaccgacgatgagatggaggcagctggtgaggtagtcgagcgcttgagtgcgggcctgtcggccaagatcgcggacgccgacgactgggagacggcggaaggctacatcacagccctcccgtacatgctctacgacaagctgcagcagtacactcaggtgcggcatggcacggctcgttcaccagcgccccacccacagcgccgagacgtccaaggccaggtggaaacccaccgggagccgcggcacgagaccattggtcagccagaccagccaggtgagccgtcaccgacgcgccgccgccgccgaggaaagcgtaaaggccgccgccagcgacgtcatccccgacggaccaattgtggtggtggtggccgtcagcagcggaagcaacggcatccacgcccaccgcgcgggacacgccaccacagggagcaccgcatcgacgaagccatcgacgaactgcacgcgctggagcgtgcccgtccccaagctcgcccagccattgccaaagctcgccgccgagttggccggatccgatcggcgatcgatcagcagcttctgcgccaccgcttcgacaccgccgagaaggagtgcgtggatggcatcttggcagcagctcgcacggcacgcgacgcacggacaacagtgagggcggccgcggcaacagggacgacagcgactccagagacggcagtgacgagcggtacggagcagcaggacgataacggcacctgccccatcccgagcgaggtgctgtggagacacttcgacagcgtcaatacgccccagagggacttcgacccggaggctcccgagggtgctgcgttccgttctgcgatggcccggctgccagcagccacgcgattcatggagctgctgaaggaagagccgtccacggacggcatcgaggtccagctgcagcacgcgagcagcacctccagcccgggcctcgacggcgtcggctacgacgtgtacaagcgcttcgcgtcgcagctgctgccggtgctgaaggcggctttcaagtgctgctggacgcacaagcaggtgccccagagctggaagctcggcgtggtgcgcctcctgtacaagaagggcgaccgtgaagacccggcgaactggaggcccatctgcctccagcaagccatctacaagatctacacgggggtgctcgcgcggcgcctcacccgctggcaggacgccaacgaccgccacgccccgggccagaagggcttccggccggtgaatggctgcggggaacacaacttcctcgcggccatgctcatcgaccacgcgcgccgcaagcaccggccactgtacgaggtgtggtacgacttccggaacgctttcggaagcgtacccctcgggctgctgtgggacgccctggagcggacaggcgttcccgccgagtacatcgctgccgtccagggcttgtacgaccacgcagcgttcatggtgggcaacgcggtggacggcagcacggcgccgatcctgcagcgtgtcggagtgttccaggggtgcccgctgagcccaccgctgttctcggcggcgatcagccccctcctccacgcgttgcagctactgcccagctcaggagtacagctctcgggtgacgaccgcccgggtgtctccgcgtacgccgacgacctcaagaccttcagcggcaccaaggcgggcgtcaccgagcagcacgagctagtggccatgttcctgcgatggaccggcatggcggcgaacccggccaagtgcaggtcgatgggcgtgcgccgcaacggcaacggcgccatcgaggcggaccacctggagctggcgctggacgacacgccgatccctacgttgacgcacctgcagtcgtacacgtacctggggatcggcgacggcttcgaccacgtgcgccgccgcgtcgcgctcgcgcccaagctcaagttgctcaagcaggacgcgacggcgctgatggagtccggcctcgcgccgtggcaggtggtgaaggccgtgaaggggtacctctaccctcgggtggagtacgccctccggcacctgcgacccgacgaccagctcctggagagcttcgacctccacctccgccgcggcctccgccacctgctccgcctccccaagagcgccaacaacgacttcgtgtacgcgccggtgtcgcgcgggggcctgggcttcctgccgctggtggagctgcacgcggcgctgcagattgcgcacgggtggcagatgatcaactcgcccgacccagccatccggcgcatcgcgcgcgagcagcttcaccaggttgccgacgcgcggcaccggctcgacaaggaccactggaagcagcgcggtgacgagctgtgcgagctcctcctcaacggggagctcgggacgtcggcccacgcgccacccaaacggcgcaacggcgacattggctcgctgtgggtcgacgtccgcaagaatctcaaggccttcgggctgaagctcgcaaccgcgcccgccgacccggagtccggcgcacctgccaagccgctgcagctttgcgtgccgcaccacgctgagtggctggaccaccgcaacgtgctgcggcacgtgaagcagcacatgaagaacaagcgctggcgggcctggtgcagccacgtggaccaggggcggacggcgcgcgcgcacggaggcgtcggcagcggtttcctgacgagaccgcggggcatgtgggagagcgactaccgcttcgcggtggccgctcgcctcaacatgcttgacacggtgaacgtgctcgcgcgcagacgcctccgcgcccacgaccgttgccgtcacccgggctgtcggtggaaggagacgttggcacacgtcctcaaccactgcccgggtacgatggacagcatccgcggccgccacgacgacgcgctcaaggaaatcgagcgcacgctccacgcgtcgtcgggcgaccgccagggccgcaccgagctccgcacgaaccagaccgtgccgggcctggccgggccagctctgcgccccgacctccaggtctacaaccacgaccaacgcacggtcgcggtggtggacctggccatcgcgttcgacgagcagccgcgcgacgacccagagagctccgggctggcgaaggcggcggccgagaagaaggccaagtatgcgggcatcaagcgacacctcgagcgccaagggtggaaggtccacctctcggcgctcgtgtacggctcgctgggctcggtggcacccagcaactacaaggtgtacaccgagcacctggggctgctcaagcgggacgccaagcggctggaccggcagctgtcggtggcgtgcatccagtccagccgccgcatctggaacctgcactgcgcccagcaccgcgccaggcagcaccaagaccaaccagccccaaggggcaggcgggtgacggagaccggggggactccgtcgcgcaccgatcgccgctagacggcaacactctggcccgcgtcggccgaaagggccccacccacgtagggaaccgccctcgggaaacccagtctggtgttcggccaagaaatgcaccaccaccacggcggaggtgcatttcgacagtcgaacttcaacccgccacatatcggatatagttacagctctagttagacatcggataggaacttcttagaaaattaacgggtataccggatggtaaataaaataaaaacttc

SEQ ID NO: 1080 - DNA, 6562 bp, Phytophthora infestans
agctcggcctcgcggctgccttcccaggcgccgccgacttcgcgctctggcgcggcccacacgccgccgccgagcctccaagcgcgcccgttggctttcgcagacgcagggctcgcggcgacggccctcgccagcccccaagaccccccctacgatgtggcaccacccggcagggcggccggcaggctgcccgactcggtatcgccgggtgctacactctcagccgctacagctcgggccttggcggtccgctattggcccttggagctcgacggcgacagcagcgacgacgaggacgctcaagacccccacgccgccgccccagaacccccagaagacgtcgcgagtgtgcttgccccacccggcagggcaggcagcatgctcgccgacccagcagcgctggcagccggtctggctcgcgctccgccgcccccatcggcaccccaggacccaagccccgccttccctgctggtcccgccggccagaaccctcgcgccgccgccccagcccgtgttgaagtccacacagtcgtggcaccacccggcagggcgggcggcatgctgcccgacccggggttggttgaagaacctatccaagcgacgtacgcgcacgacgctgcccagttcgagtgtgcgttgtgcccgtacgtcgctgagagcatggcagtgctcgttcagcaccgacggtcggctcaccgcggcacccgcttcaaggacatcttcaccagcgggtgccagtgcagcctagtgttttacgcgcgcattgttgccgccagccatgcagtggcctgtgccaggcgcaaccagcgagccgtgccaccagctccgacccctgttgcccccacgcggcccgaggctaccccacaacctactgggtacctcgccgcggcgatgactgccgctgcggcagccgcatcaagcgacaccgtagtggcagccgccaccaacatgcagagcgccgtgccagccgccgccaagactactgggcttcagctcgtcccccccgagctggagcctgcccttccgcagcgtgcttcttgccatgcaggcaaacgccgtcggctcaatgccgacgaggcagtgacaccgtgtacgcctacggcgcgggtgtcgccgcaaacagaagtggcgatggcgcctcacgacgcaccccaggacgacaccgtcctacagcgtgaggccgccgagccacagccagacccagcagcaacgcagggtgcccaagtgcagcgagtcgaagacacaactgcggcgcaggatgacactgtgcagcaggaccacgacgccgacactgcccaggtctcgccgccccggcgcacaccgacacgctggggaccaagaccaagctcaactcaagagcctagccccatgacaggcgagccggctgccaccctggcagcgcgaagaccactgactcctgccgcaacgggcactcgtgccacgcggtgggggccatgtcaccgcgcgatcggggccgcagccatcgcacgacttgtcacgggccttccaacggagccagcgcagcctcagcgacggcagccaccgccaccacaagaacctcctttgcagccagagccacaagcagcagcagcaacagtcgcagcagacatcgcagcaacagtagcagcagacattgcggcagcagcagcgaacgcagcaatggacgtggatggtggaccggcagccgacgagacatggctgttgcgctttgacggcgcatgccgacggaacccaggacctggtggagcaggtgccgcactctttgcgcccagcggtgccgtagtatggacgtgctcgcacttcatgccgagccgctccgaaacgaacaacaccgccgagtacacggcgctactgctcggcgcacagagcgcagtccaccacggcgccaaacgcttgaatatcgagggcgatagccacctgatcctctcgcaagtgcgcggtgccttcgcgtgcaacaacaagcggttgcggtctctccgaaaccgagtccaggcctctcttcggcagctcgactggtaccgcttgcagcacatcgaccgcaaggccaaccagcatgccgaccgcctcgcgaaccgcgccctggacctgcgccgcacggtgaccgagtgcggcccacacgcggagactcgcaatcggtgctttcagacaccgcagcccctcgtcgagcccggcgagacgcattgtgtaccggggtctgatgaggtcctcgctgctaataccgcgatggaggatgcgaccgctgtgcctaccgaagacgacgaggctgaggttgcagcgcgagacgggggtgaggtgtttccaaccatcgccatcgggcctgactccgcccctgccaagcaaccacggcttcgcctcaagaagctggacgaagacgatttcgatgcggctgccgccgccgtgacgcgtgtgtccgaggagctggcaagcaagatcgtggacgctggcgactggacatcaggtgaaggctacatcagcgcaattcctgaacgacttcgagcagcgctccggccatttgcccttccgacgcagccagcacgaccacagccccgggagcctcgtatgcagcagccaccccgccggccaccccgcgtcacacgcgaccacctggagcacaggcttgacgaggcgctcgacaccatggagaatgtgcagcgctccacgccgcaaaaccagaaggcagtgcgcagggcccggcgccgtgtcgggcggcttcgttcggcgatggaccggaccagactgcggaagaagttcgccacacacgaacgggagtgcgtggccgagatcctgcgacgtgcttcaacggaggaggcggcgaaccccagtcaggagaaatgtcctatcgaccgcgccaccctccacgagtactttaccgccaccagcacccagcggacaccattcgactacgacagcgccaaaggcacagagttccgcacgttcctggaggtgatgtcgacgcctagccacgagacaagcgcgttgaccgcagagcctacgctggacgagatcgaagaccagctcgcccacgtcaaagccggctcaagtccagggcatgatggggtcgggtacgacgtgtaccgccgcttccaggttcagctgctgcccctcctgcatgcagccttccggttttgctggcgccaccgccgcgtgcctgccctgtggaaggtcggcttcgttcgcctgctgcacaagaaaggtgacccgcagcagccaaacaactggcgaccaatctgcctacagaccgccatctacaagctctacagcggcctcctcgcccgtcgactgtccaagttcctggaagccaacgagctgttgcccatggcacagaagggcttccgagcgttcaacggttgccacgagcacaacttcgtggcaaccacgctcctggaccagacgcgccgcatgcatcgcaggctgtaccaggtctggtacgacctgcgcaatgctttcgggtcgctgccgcagcagctcatgtggggcgtcttacgccagcttggggtgacagaggagtttgtggctcgctgcagtggcatctacgaggactcatacttcgtggtcggcaacgcgagcgacggagcgacggagccagtgcgccaggaggtgggagtataccagggctgcccgctcagccccctcctctttatcactgcgctcgtgccactcctccgggcgctagagaaccaggatggcgttggcgtcccgctcgcagacggagtacgcccgtgcgccaccgcgtacgcggacgacatcaaggtcttctgtgacagcgcgacgggcatccagcgctgccacgccctcgtgacgcgcttcctggagtggactgggctgcaggccaacccggccaagtgcgcgttcctgccggtgacacgcagccagcacagcaaccccacacgcgaccgagacatcgagcttcgcatccacggcgaggccatcgccaccctcggacttcaagaaagctaccggtacctgggggttggcgacggcttcgatcacgtgcgacaccgcctccagctcgaacccaagctgaagcagatcaagcgagaggcggtggcactgctgcactcggagctggtgccgtggcagattctcaaggctctgaaggtgtacatctacccgaaggtagagtacgccctcagacacctgcggccgctcaagtcacagcttcagggcttcgacagcgccatcgtgcgcggcctgcgccacctgctccgcctgccggagaacagccacgacggcctcttcttctcacccacctcggctgggggactgggactgctgtcgctcgtcgagctgcacgaagcgctgcaggtggcacacgcgtggcaaatgctccactccaaggacccggccatccgtgccatcgcgcgcacgcaggtgggacaagtggcgcgcaagcggttcaagctggtcgaggagcactggcgcggacgggaagacgacctcgcacagcgcttcctcaacacggagctcgccgcctcgccccacgccacggagacacgccgcaacggcgacatcggttccctatggaacgacgtccgcgacacgctgcagaccctcggactcaagttcgccgcaggcgacgaggaggaagcacctggactactgcagctccgcgtgccgcaccacaccaagtggctcagccactcgacggtgttgaggcacgtgaagctgcacatgaaactgcgccgcatggacacgtggaagtccaaggtcagtcagggcacgacggtgcgagagcacggcggcgtgggctcacgcttcatcacggcgggtgcaggcctgtccgacgccgagtatcgcttcgctattgcgccccgcgcccacctgattgataccaacagcaccctcaagcgccgtcgactccgggccaacgacacctgccgggctccgggatgctcctacacggaaccccccgcccacatcctgaacaaatgcagtcccaacatggacgcgatcaggaaacgccacgacgatgctctcgagcgtatcgctgacgccctgcggcgcaaggtggagaagtccggcggcaggctcgaggtggccatcaacaagacggtaccggagtacgacggcgcggccctgcgccccgacatcgtactccggaacacggagaccaagcgtgccatcatcgccgacctggcgatcacccacgagaaccagccgaccgacgcgaccacgtcttcagcgctacagcaaagccgtgacaacaagattaccaagtaccagacggtcgcggcggcaatgatgcgcgccggttggcgggttcgcgtgacgggcatcgtctacggctcgctcggctcagtcctgccgagcaacttcaaggtctacaccgagctgctggcgctgctcaagcgggacgcccgccgccttaaccgccagctctccagccactgcatccgggccagcgcgcggatatggagcgcgcactgccgacgacaccgtgagcggcaacgaagcggcaatgcctcgcgagcgtcgcgtgggtccgggggggccccgcggcgcacatcgcaggcatcggcacggcggtaaacgggtcacttgaccgacagggcaccacccaggtagggaaccgccctttaaaacccaggaagacacaaacaccctccacatagtgacatacatattttagcctagatttcagttacggagaggttactaactggtacataaaattacacattctgttctaatcagtgtgaaaactggttttcgccttttggcggactttttcactcgcatttttgggcaatcgtctgcggctagcttgctagcggcggacgagcggtctccgggggcgtacacctttcccccgcgaggccaactacaccgatcttctctacacttttctaattcgccttcgtcttcggtcttcggctgtcggatttttttctttttgaccaatcagagtgcgccatgcgactcttctggccaatcagagaccgggccctgtcctcggacagcgaggcctccacggccagccaatcaagtctcggcagcgacgcgtctttctatagcgcagctgacgaggccgatctggcggcccccgattggtccgactttcggccaatcagcgacgacgagggggcaggagtttacacttttgcccccgtttcgacatcaacttcaggccaaaatggcgatttcgaccctccacgcgccgtgccactgctcggcaccggcggcgattcagcgggtgcaacttcgggcacgtgtgcaacacatgcagcgcccattgcacgccaagcggcatcgcgggacgacgcctcggccgctcaagcgcagccccgcccttccagcacgacctcgcgccgtttggcggatcgccatcaagacgtgcgagagccaggcggggtcgggcaaaatatacttactctaagtatgcccgaatccctgccctctcaggctgtacgcggccccatacttgatctaagtatgggaggatccctggcctctcaggctgtacgcgagacccgtacggccgaatccctggcttctcagcctgtacgcggggctatacttggtctaagtatgccccggtcgctggcctctgagcccgtacaca

SEQ ID NO: 1081 - DNA, 5021 bp, Phytophthora ramorum
ccaggaatcacccccgccgcccccaagcgctccgccgccgagcccagctgcggctgctgccgccccactggtgacggcagtcgcagctgcccctgccacctctcctgttggccgcgccgccgtggagccccgcgcgcgcgccgagccgccccaagaacaagcacccccagctagcgcgcgcgtggagcccatgtcgggcgacgtggtcagcagcgacggcagcagcaggacgacggacgcgagcggcgacggcgacgacggcgcaggcagcagcgatgcagcaggcgatgtcggcgtcgtcgccatggatgttgaccaaggtgcccgccgacagcagccgccatggcagcgcgtcggcggcaagcgtcgacgtctcaacgacgtcgacgacgaagacacccgcgagctggccgagctcctgctcgaggaggaggacgaggctggggaccacgctccagcgcctaggctatccgcggccagcgctcgcccggcctccgtcctctccgtgtacgcgcacaatgcgcagcgcttccagtgcacgctgtgcacgtacacggccgccagcttcgcgtcgctcaagcgacaccgggactcccggcaccgccgcaccgccttcctcgaccggttctcggcgggatgtgcgtgcggcgtgcccttcgcgtcgaggctggctgctgcgaaccacgcacacgcgtgcgacagcctcaaccgcaccttctcggtagcggctgcgccggcagcaggggaattgagccccactgctggtgcagccaacgccactgtcaaggcggccactgtcacgcccgactccccccgccaagaccccccgaagctcgcagcgacccccccgctagcgagctccgctcttgtcgtcgacccggaccacgccgagcaacaagcccgcgagcgctggggcccgcccctacccaggacgctggtggcaggccgtgttgcagcccgcctcagcgaggttccagctccccgctggggacccccactgccacgcggcgtggtggcattccggatcggccaccgcgtgctcccgccggagatgacgagcgacgaggagacgaaggacgactcgagtgtccaggacggcgaccgccaggactacccggtggccgcgatggacgtggacagcggcatgagcggcgagtggctgctgcgcttcgacggcgcctgccgcgccaaccctggcccaggtggcgccggcgcagcgctgtcccagcccgacggctccgttgtatggacttgctcccactacatgccgagcagcagcgaaaccaacaacaccgccgaatacacggcgctgctgctcggtacgcgagccgccgccgaccacggaaccacgaccctgcgagtggagggcgacagcaccttggtgatccagcaggtgcgtggcatctttgccacgcggagcgtcactctccgccacctccgcgaccaagtcaagctggaactcgcccgggtggggagattttcgctccaccacattgatcgccaagccaatgcccacgccgaccgcctcgccaaccgagccctcgacctccggcggacagtgtcggagtgcggcgtccaccccgacgggaacggctgcacgcccacggccatcgacgaccgacccctagcgccgactcagcagccacctgacgccccgccaccgccgcccgccgccgacattgagatggaggacccggacgacgaggacctcgccgacatcgacgacggcgaggtctacgcggccatgcgcgttggcccgaatgccactccgcagcgacgacgccgtggacgctcaggcaccgcgaagaagcaccgccgccagcgcccaccccgggtgacccgacaccaccgcgaacaccgcctcgacgaggcactcgatgacctccatgcagtggagcgctccacccccagcgaccgcaccaccgtccgccgggcacgacgccgcgttggacgcgtcaattcggccatcgaacagcagcgcctccgccaccgcttcgacacggacgagaaggcatgtgtcaccgacatcctggcgaaggcgtgcgcgacgcgagaggcagcgaggaccacggcctccggcggtgatccacctgcaggcccggcgacgccagcggcaggcagcgcagacgacggcacctgccccatcttgggagaagaactctggcggtttttcgacagcgtcaacacgccgcgccaagaattcgccccggacgccccggtgggtgccgccttccgctcggcgttggcacgcctaccggccgcgaccagttgcaaggagctgctgactgcggcgccgtcggccggcgaagtggaagaccagctacaacacgtccgtggcgcctccagccctggactcgacggcgtcgggtacgacgtgtaccagcacttcgcggcgcagctcctgccggcactgaccgcggcattcaaggcatgctggacggcgaagagagtgcctcagagctggaagctcggggtggtgcggctgctccacaagaagggcgcgcgcgaggacccggcaaactggaggccgatctgcctccagcaagccatttacaagctctacacgggactcctcgcgcggcggctggtgcgttggctagacgccaacgaccgccacgctccaggccagaagggcttccgagcggtgaacggctgcggggagcacaacttcctcgcagccacgctcgtcgaccaagcccgccgcaagcgccgcaccctcttcgaagtctggtacgattttcgcaacgcgttcggcagcgtgccattcgcgctgctgtgggacgcgctggcgcggctcggcgtgcccgacgactacgttaccatgtgcaaggggctctacgagagcgcggcgtttgtcgtcgggaacgctatcgacggcacgacggacccaattgcgctgcgggtgggcgtcttccaagggtgcccactgagcccccaactcttcaacgctgccattagcccgctgctcttcgcgttgcagcggctgccggccacgggcgtgcagctgtcgggcgatgactgccctggtgcctcggcttatgccgacgacctcaagattttcagtggcaccgaggacggcatcaagcgacagcacgcgctcgtggccgacttcttgcgctggaccggcatggcggcgaaccccaacaagtgctgcaccatgtcggtccagcgcgacggacgcggcgtgctcaagactgacgacctccagctagacctggctggcacgccgatccccgcgctgtccatgagcgcttcgtacacctacctggggatcggcgatggattcgatcacgtgcgccgccgcgtcgagctcgctccagcactcaagcagcttaaggacgacgcgacgacgctgctgcagtcgggcctcgccccgtggcaggtggtgaaggcggtgaagacgtacctctacccccgggtggagtacgctctccgccaccttcgccccttccaacagcagcttgagggcttcgaccggcacctcgcgcgcggcctccgccacctcctgcgactgccgggcaacgccacggcggagtgcttctacgctccggtgtcgcgcggcgggctgggcctgctgccactgacggagctgcacgcggcgctccaagtcgcgcacggatggcagctgctgaattcgaaggaccctgccatccggcgcatcgcgcgcgtgcagctccggcagatcgccgacgcgcgccaccgtatcgacagccgcgcatgggaggggcgcgacgaggagttgtgcgagctgctgctcaactcgcagctcgggacgtcgcccgacgcgccaccgaagcgtcggaacggcgacatcggttctctttgggtcgacgtccagcgccacctccgcacgctcggcctcaagttcgcgaccgcgccggcctgcgcggacgccggctctgcggcgaccacgttgcagctccgcgtgccgcaccacgataagtggttggaccatcgcactgtcctgcggcacgtgaaactgcacgtgaagcaccggcactggtccaagtgggcggccatgcgcgaccaaggcaagacggcccgcgcccatggcggcgcggggagcggcttcctcacccggccacgaggcatgtgggaagccgactaccgcttcgcggtggccgcccgcctgaaccagctcgacacgcacagcgtgctgaagcgccggcgtctccgagcccacgaccactgcaggcagccgggctgctccagggcggagacgctggcgcacgtgctcaaccactgcgccggcaccatggacgcggtccgcggccgccacgacgacgccctcaagcacatcgagcgcgcgctgcacgcgtcgtcgccgggcggccaggaccgcgtcgagctccgggtgaaccagacggtgccgtcgctcgccggccccgcgctacggcccgacctccagctgtacaaccacaccaagaagatggtggcggtggtcgacctggccgtggcgttcgaggagcaggcgagcgacgacccggagagctcggcgctggcacgcatcgccgcacacaagcgcgcgaagtatgccggcgtcaagcgacacctcgagcgccaagggtggaaggtccacctctcggcgctcgtgtacggctcgctcggcgcggtgccggccggcaaccacaaggtgcttactgagcaccttgggttgctcaagcgtgatgcgaagcggctggaccggcagctctcggtggcgtgcatccagtccagccgccgcatctggaacctgcactgcagccagcaccgcgcgcgccagcaccaagcaccagggggaagtcgggcggcggagaccggggggactccgccgcgcaccggccgccgctagacggcacacaggcccacagcggccgacagggccacacccaggtagggaaccgccttcaaacccggccggtacattatggtccgacacctatgaggtgcaaccggtacacaagttacacaccacatagcgactaccaggtatttactacctggaagccaaggattaaccggtcggtaatacacataacttt

SEQ ID NO: 1082 - DNA, 5369 bp, Phytophthora infestans
ctcaagcctagcagcggctaccgcagctactccagctccggtagctgctactgctacaactgctcgcgctgctgctcgcgtcgccgtggagcaccacgcgcacgctgaaccgaaccaagaacatctaccgatggctcgcgtgctcgtggagcccatgcaggtcgacgagtgcagcagctgcgaccgcagcactttgacagccgacgacgggagcggtgacgacgttgcagccccaagctccttgaacagcaacgacgtcgccgcccccatggacgttgactccggcactgattgccctccagcgttgcaacagccgccccagcgaccgcgtgcgctgcacgtaggcagcaagcgccgccgactcgacgcagatgatgaggaagaagctcgccagctgcaagaagaggaggaggctggcatccatgccccagcgctcaggctatccgcggccagcgctcaaccggcctccgtcctcgccgtgtacacgcacaacgcgtcgcggttcgactgcacgctgtacgcgtacacggccggcagcttcgcatcactgaaaacgcacaggaactctcggcaccgccgcaccgcattcctcgaccgattctcggcgggttgcgcgtgtggcgtgcccttcgcctcgaggctggctgcagcaagacacgcgcaagcgtgcgccagcctctcgagcgcaccattggccgaggcttcgtcggcagcaggagcatcaagccacactgtcgacgaagccgactccaccgtctcagccgcgggtcacaccgagcccgacctgccccgccacaacgccacggagctcacagcgtcccccccgctggtgagctcccccgatgttgaagtgcaggcaccagagacagaggccaccgagaaccgctggggcactccacttccgcgcgtgctggtcgcgtctaggatcgccgggcgcctcgctcaggtgccacccccacgctggggccccccgctaccgcgcactaccatcgcgggccgcattgcgacgaggctcgccgccacacctgccccccgctgggacccaccgctgccacgaagcctggttgtgtcacgcatcgccgcccgcctgctacccgcgctaccagacgcgcctgcatgcgaggaagaggccaaggacagcgacacgatggactgggcgccaacttggacaaacgaggagaccaaggacagcgagccgcatgacgaagcgccagggcaggtcgacgaggagaccatcgacgacgccgacggcgagtggcttttgcgcttcgacggtgcttgccgtgcaaacccaggcccaggcggcgccggcgcagctctcttcaagcccagcggccccgtagtgtggacttgttcccactacgacccgagcaccacggcaacgaacaacacagcagagtacactgcgttgctgctcggggccagggctgccgccgaccacggcgtcacgaagctgcgcgtcgagggcgacagcacgctggtcatccagcaagtgcggggcatcttcgcgacgagaagcacgcggctccgagcactgcgcaacaaggtcaagctcgagctcgcgcgcgtggggagcttctcgctccaccacatcgaccggcaggcgaacggccacgccgaccgcctcgccaacgccggcctcgaccgacgccgcaccaagctcgagtgcagtgtgcaccccgatggcaggggctgcaccaacacctctgtggcgaccgcagcgcctactgctcctgcagcgcccttgcccccagcccggcctcctgcaactacagccgctccgtctcatgatgacgaccacagcgttcaaggcgacatcgacgatggcgaagtatacgctgcaatgtgcatcggccccgatgcggtgccgcaccgccgaccgcgcctccgcctacggcacttgacggacgaggagtccgaggaggctggcgacgtcgtggagaggctggcagcgtcgctggcggcgaagattgcagacgcgcccgactgggagacggcggagggctacatcacagccctaccgtacgctctctacgacaagctgcagccgtactcccaggcccagcctcagcctccaagccaacagcagcagcagcagcagcagcgaccacggcagcagcagcaaacacggcagcgtcgacagcggagaggcaagcgcggcggtggcagccaacgcaggcagcggaagacgcgccgccgacggcccccgcgggtgacacgccaccaccgcgagcaccggatcgatgaagccctcgacgacctccacgcgatcgagagcaggcgccctcaagacaggacggccatcagcaaggccaggcgtcgagtcggccgcatccgctccgcccttgaccagcaccaattgcgccaccgcttcgacaccgatgagaaggtgtgcgtggacgccatcctggctggggcgcgagcgagccaaggagcgacaacggcaccaccgtcggcaaccacggaccccccagctccgatggacgacagcaggtgccccattcccggcgacgatctatggaggtttttcgacagcgttaacacgccacggcggtcgttcgacgcagaggcaccagacggagctgccttccgcgaagcgatggcgtgcttgcccgccgccacgagagcccaggaactgctgacggaggcgcctacggtggacgaggttgaagaccagattcagcacgcccgcgccagctccagccccggcctcgacggcgttggttacgacatctacaagcagttcgccgcccacctcctgccagcactgcacacagcgttcgtgtgctgctggaaccacaagcgggtgcctcagagctggaagctcggcgtggtgcgccttctccacaagaaaggcgatcgacaggatcctgccaactggcggccgatctgcttgcagcagaccatctacaagctctatgccggcatcctgtcacgccggttcgtgcgctggctggacgcaaacgctcgtcacgcagaggcgcagaaaggattccgggcgatgaacggctgcggggagcacaacttcctcgcggccacgctcgtcgaccacgcccgccgcaagcgcaaggagctgcacgtcgtgtggtacgaccttgccaacgccttcggcagtgtgccacacgacttgctatgggaaacgctggcgcgccaaggcgtaccgcccacgttcgtggactgctgccgcgggatctacagtgatgcagccttcaccatcgggaacgccgccgacggcaccacagcgcccatcaggcttcgcgtgggagtattccagggctgcccgctcagcccccacctcttcaccgccgcaatcgccccgctgctccatgcgctgaagaggctgccggtcactggagtgcaactcaccggcgtggaccgtcccggagctgctgcctacgcggacgacctcaagacgttcagtagctccgtggacggaatcaagaggcagcacgagctcgtggcgaccttcctacgatggaccggcatggcggcgaacctttccaagtgcagcgccatgtcggtccagcgcgacagccggggcgtgctcaagacaggtgacctatgcctcaagctcaacgacgcagagatcccagcgctgagcatgacggcctcctacgcgtacctcggcatcggggacggcttcgaccacgtgcgccgccgcctcgagctcgcgccaatgatgaagcagctcaagcacgacgcgacggcgctgatgcagtcggggctggcctcatggcaagtggtgaaggcggtgaaggtatacctctacccccgcatagagtacgcccttcgccaccttcgcccgttcaaacagcaattagaagctttcgacgagcacctccgccgcgggctccgccacctgctgcgactaccgacgaacgccaccagcgccttcttctcagcgccgacatcgcgcggcgggctgggccttctgccgctgacggagctgcacgcggcgcttcagatcgcccatgggtggcagatactcaactccccagacggcgccacccagaggattgcccgcgagcagctccgggagattccagacgcgcgccaccgcctggacactgcccactggaggaaccgcgacgcagagctgtgcgagctgctgctcaactcgcagctcggacagtccagccacgccccacccaagcggcgcaactgcgacatcggatccctttggatcgacattcggcgccagctcggcacgctcgggctcaaattcgagaccgcgcctggccgacgcagtcaccaaccagcccgcccagccattgcagctttcgcgtgccgcaccacgacaagtggctgacgcaccgtgacatagtgcggcacgtgaagatgcacatgaagctccgacactgggccaagtgggcggccatgcgcgaccaaggcaagacagctcgtgcacatggtggggttggtagtggcttcctcacacggccgcgaggcctgtgggaagccgactaccggttcgcggtggccggccgcttaaaccaggtagacacgcacagtgtcctcaagcgccggcgcctccgagcacatgacaggtgcagacacccaggatgcacgcgctccgagacgctggcgcatgtgcttaaccactgcgacggaaccatggacgcagtccgtggccggccatgacgccgcactcaagattattgagcgtgcgctcctcgcatcgtcggccgaccagcaggaccgtgctgagctccgcgtgaaccagaccgtgccgtcactcgccggccccgcgctacggcccgaccttcagctctacaaccacaccaagaagacggtggcggtggtcgacctggccgtggcgttgaggagcaggcgagtgacgacgcgagtagctcggcactgtcccggatcgccaaccacaagcgagccaagtacgaccacatcaagctacacctcgagcgccaaggatggaaggtacacctctcggcactcgtgtacgggtcgcttggggcggtcgctagtggcaactaccaggtgtacaccacacacctggggctactcaagcgcgatgcaaagcggctggaccggcagctgtctgcctaatgcatccagtccagccgccgcatctagaatctacactgcagccagcaccggactcgccaacaccaggcgaggcccagccaaggaccaagaggcagccgggcgacggagaccggggggactccgtcccagacaagccgccgctaggcggaaaccaggcccaagacggccgacagggccccacccaggtagggaaccgccctagaaacccatttcggtggtcgactcgcaagccttacctatattttagacgtagcgaccaaattacaaatttggtaacgagtaagccaaatggtaatacacaaaacttt

SEQ ID NO: 1083 - DNA, 5423 bp, Phytophthora ramorum
ccaggcatcacccccgccgcccccaagcgctccgccgccgagcgcagctgcggctgctgccgccccactggtgacggcagtcgcagctgcccctgccacctctcctgttggccgcgccgccgtggagccccgcgcgcgcgccgagccgccccaagaacaagcacccccagctagcgcgcgcgcggagcccatgtcgggcgacgtggtcagcagcgacggcagcagcaggacgacggacgtgagcggcgacggcgacgacggcgccgacggcgcaggcagcagcgatgcagcaggcgatgtcggcgtcgtcgccatggatgttgaccaaggtgcccgccgacagcggccgccatggcagcgcgtcggcggcaagcgtcgacgtctcaacgacgtcgacgacgaagacacccgcgagctggcagagctcctgctcgaggaggaggacgaggttggggcccaagcaccagcgctcaggctattcgcggccagcgctcacccggcctccgtcctctccgtgtacgcacacaatgcgcagcgcttcgtgtgcacgctgtgcgcgtacacggccgccagcttcgcgtcgctcaagcgacaccgggactcacgacaccggcgcgtgtccttcgtggacaagttctcggcgggctgcgcgtgcggcacgcccttcggctcgaggctggcagcggcgagacatgcgcaagcgtgcgccagcctctcgatcccacgcacggtaacagctccggcggcagcaggagatttgagccccactgccacgggagccaacgccaccgcctcggcggccgcaacttcgcccgatttgccccgcccagcttccccggagctcgctgcgtcccccccgcagacgagcccctttgacgttgccatacaggcagacgctgcagagcagacagcgtggacgcgctgggaccctccgctcacccgcgctgcggtggcagcccgtgtcgcctcccgcctcgccgtggttcccgcgccgcgatgggggccgccgctgtcaaggacgctggtggcctccaggattgcagcacgcctggacgcgcagacgtcacgatggggaccgcccctgccaccggcgatggtggcgtcccggattgcgtcgagactcgccgccatgccggcaccccgctggggcccgccgctgctgcggaccgtgatcgcatcccgcatcgccgaccgactgctcccaccggagttggcggccgacgaggagacgaaggatgacgacgtccacatggacaacgcggccagcgtggacgtcgacgaggagtccgaggtcgccgacgtggtcatgaccgaccacgacggcgaatggctgttgcgcttcgacggcgcctgtcgtgccaaccctggcccaggcggcgccggagccgctctgttcaagcccagcggccccgtagtgtgggcatgctcgcgctacatgccgagcagcagcgcgaccaacaacacggccgagtacacggcgctgctgctcggcgctagggccgctgccgaccatggagccacgcacctgcgagtggaaggcgacagtacgcttgtgatccagcaggtgcgtggcatcttcgcagcgcgcagcacccggatgagggcgctgcgcaaccaggtgcagtccgagctcgcgcgggtgggcagcttctcgctccaccacatcgacaggcaagacaacgcacacgcggaccgccttgccaatcgcgcgctggacctgcgccggaccgtgatagagtgcggcatccactgtgatggtgttggctgcaccgccaccacgacggaggtacagtcatcatcagcgcccgagataccgacccggccggttgctgacgaccatgatgaacatgaagttgttgatgttgttgatgtttgtggagtttgtggagtttgtggcgaccgtggaacttgtggagtctgtgacgttagtggagatatcgatgatggcgaggtctacgcagccatgcgtacgggacctgacgctgttcctgcgcgccgaccacgcctccgcttgcggaaactcactgacgaagagcaagaagaggcaggcacgctggcggaacggcttggagcgacgctggcggccaagattgcagacgcacgcgactgggagtcggcggagggatacatcacagccctcccttatctactctacgacaaattgttgccgtactcccagggcccagctcgctccttgccggtccgccagcaccaacggcagcagcagcagccggacggacaattccagcgacccacccagtcccgatctgcggctcgtcgacagcgacgccagcgccaccgggcacgtcgccgaccgccacgcgtgactcgtcaccaccgtgaacaccgactagacgaagcgcttgacgacctccacgcggtggagagagctacgcccagcgaccgccgctccattcgccgagcccgccgccgggtcggccgcgttaattcggccgtcgaacaacaacggctccggcaccacttcgatacgaacgagaagggctgcgtggagatcctactggccaaggcgcgtgcacagaggtcgacgacggtggcccggacggcagttggagagccgaacagcggtgcggccgaggacgacggcacgtgccccatcccgagcgagcgccttcaccgccatttcaccgaggtgaacacgcccgggtccagctttgatgcgatggcccccgtgggtgcaccgttccgtgcggcacttgcgcacctccccgcggccacagaggcctcggagctgctgacagaggcgccgacgcccgatgagatcgaggatcagctgcagcgagccaagggaacgaccagccctggcctggacggagtgggctacgacgtctacaaggccttctccacccagttactgccggtgctgcacgcggcattccagtgctgctggcagcaccaccgtgtgccgcagagcaggaagcaaggcatcgtgaggctcctgtacaaaaagggcccgcgcgaagaccccgcgaactggagacctatctgcctccagcaagtgatctacaagacctacgccggggtcctcgcgcggaggtttacgcgctggttggctgcaaacggccgccatgccgacgcccagaaggggttccgcactgtaaatggctgcggtgagcacaattttctcgcgtcgacgctgatcgatcatgcgcgccgcagccgcagagagctccacatggtctggtacgacctgaagaacgccttcggcagcgtgccccaggagttgctgtgggaggtgctgcagcgcatgggtgtcccgccagcctttgtggaggtctgccaggggctgtaccaggatgctgccttcaccgtcggcaacgctgctgacggcccgaccgatctcgtgcggcagctcgtgggcgtgtttcaaggatgcccgctgagcccccacctgttcactgcggcgatcagcccgctcctccacgcgctggaccgactcaaggacacgggcgtgcggctgtcagcggacgaccgtcccggtgcctcggcctacgccgacgacctcaagatcttcagtggcaccgcggacggcgttaagcgacagcacgcgctcgtggccgacttcctgcgctggaccggcatggtggcgaaccccaacaagtgctgcaccatgtcggtccagcgcgacggacgcggcgtgctgaaggcctgcgacctggagctgcagctggacggagcccggatcccctcgctgatcatgaacgcgtcgtacgcgtacctggggacaggcgacggctttgaccacgtgcgccgccgcatcgagctcgtcccggcgctcatgcagctcaaggacgatgcgacggcactgctccagtcggggctggcgccgtgtcaggtggtgaaggcggtgaagacttacctcttcccgcgggtggagtacgcactccgccacctccgcccctttcagcagcaactggaaggctttaatcgccacctcgtttgcggccttcgccacctgctccgacttccggtcagcgccacgaccagcttcttcttcgtgccggtgtcgcgcggcgggctaggcctgttgccactgacggagctgcacgcagctccggctgatcgccgaccggcgccaccgcctagaccccgaccactggaaggagcgggaggagaaaatatgcgagctgcggatcaactcgcagctcgggacgtcggcccacgccccacccaagcgccgcaacggcgacatcggctcgttgtgggtcgacgtccagcgccacctccgaggactcggcctcaagctagagaccgcgccggcgtgcgcggagaccggcaccgcggaggcgacgctgcagcttcgcgtgccgcaccacgagaagtggctggaccaccgcacggtcctgcggcaggtgaagctgcacatgaagaacaagcattggcagcggtgggccgggatgaaggaccaaggcaagaccgcccgcacccatggtggtgcagggagcggcttcctcacgcggcctcgcggcctatgggagaccgactaccgctttgcagtggcgggtcggctcaaccagctggacacgcacagcgtgctgaagcgccggcgcctccgcgcgcacgaccagtgtcgacagccgggctgctcccgtgccgagacactggcacacgtgctgaatcactgcgccggcaccatggacgcggtccgcggccgccacgacgatgcgctcaagaccatcgagcgcgcgctcatcgcgtcgtccgggcggccaggaccgcgccgagctccgggtcaaccagaccgtgccctcgctcgccggccccgcgctgcggcccgacctccagctcttcaaccacaccaagaagacggtggcggtggtcgacctggccgtggcgttcgaggagcaggcgagcgacgacaccgagagctctgcgctggcgcgcatcgccgcgcacaagcgagccaagtacgccggcatcaagcggcacctcgagcgccaagggtggaaggtccacctctcggcgctcgtgtacggctcgttgggcgcggtgatgcccgccaactacaaggtgcttactgagcaccttgggctgctcaagcgtgatgcgaagcggctggaccggcagctgtcggtggcgtgcatccagtccagccgccgcatctggaacctgcactgcgcgcagcatcgagcacggcagcaccagggccaagcgccaaggggcagtcgggcggcggagaccggggggactccgccacagagcggccgccgctaagcggacatcgggcccgtagcggccgacagggccacacccatgtagggaaccgccctctaaacccgcccggtacattatggtccgacacctatgaggtgcaaccggtacacaagttacacaccacatagcgactaccaggtatttactacctggaagccaaggattaaccggtcggtaatacacataacttt

SEQ ID NO: 1084 - DNA, 7375 bp, Ciona intestinalis
atcaacccactactacaccctctacaaagaacccactacagcaagatcttggcgaccaactacacctgcagcctcccgtcgactcttcaccacctgcgcacctccctccgactccaagcggcagacagtggcaccaccagcactccaagggtccacagccagaagagtgcaccccccactgctaggaagagctaggccattgcccgctgtgggccttgtgctggctgtctgccgctgattggcacgttagggagtgtgcgctgagcacgatagggaggctgctgaagccgaagaacccgcgccggggactttaggactttaactaaaatctgtaacactaaaattggaatactggattactattggattactactggacaataacctgatctacaacaaccaattggattacagaaccaaattacaatctcaactacaaacaaaaagtgagtccccggccgggtttctatattacccaattactgtttttacaattttaaaattttatagtattttactaatttttccgccccgctagcacttaaattggcaccccccccccccstccaaaaaaaaatagataaccctccaccacctaaaccccggtcaccccctcagaactaattggaacccggatcttttccctctatcaaatttccggttcagtttggcttaattacctaaaacccgtctttattttatccctttattgccccttaaaccaaattattcaaattgaaatccggccaaattgccttgctgaaccaccatttttgtttttcttataaaagtaaatttttcaacaacccaaaatcataaaattaaaactgttatctgattagtctaaattctgttattgacaaaaacctccataccaaccttaatcttatcattatcttcacccagactgctcaatctagttcttttttcaatcaataaggaggtgttttctttggtctgttgttttatagtttaccgttataatagtctgttgtcctatagttttccgtggtgtatttctggtctactatagttggtgcctctaaaacattattataccgaagagtgctagcgatttctattattaactcacccaccagtactgctgtgcatccacgcagcaccacgcctgccatcacgtacagtgcgcttgctgccttgtgttttgttttgcagacaccactggacgatagatggcgacttcgtcttcctccgtttcatcggggaatgttcagaccgaggtgcgttgcgtctaccacggaaaaggagacttgttgctggaatgcccagttgcccattgccctagcatacaccccacagttgccacaatcacaaaacacttaaaaaaacatcacacacctcaattcgaacagataaccactaaaaatctcacaataacatatacatgcagtcaatgtagtttctccaccaccggtctcacacaacaccacatatccaaacactacaaaacatgcaaaggcgtgggcgctgttcaggaaggcaacaagggtcgattctgctgccctgcatgcggtaccaggtgggctcttttgtgtaaggcacggcaccattttaataatgtccacttcgagtatgacacccctccaattgccgctttctctggcacaccctataaactaaaaaaacggaaatttacaattattaataaggccctaacatattcatgccctctccccctcaaccaactactttgccctttgtggtcgtgctccctcacgatcttaaataaacctctttcaagcgtgcagcaggaaacggcacatggcgacggctcacaaggccagagttatgttccaactcagttgcggcaggtgctcagagcccgttgccactgcggaaaccctccaattggaaagggccactgggcatcttgccaagggaagcgaccactctcttcacctaagggtgggcgcagttcgcccactccacctgctaatctaaccctccacttccttaactatctccccttccaacttccctcacaaagctcctccccccaaagtagcaccctcgaccctacggcctgtaaagctcgagtccccatcccctctttcctacgcggcgactgtgaagtcacctttttcatcatcccctccgttaatttttatagaccctacctctcctaccccctcaggatgttctggcgtaaccgaacatcctccggtcactgttccctacaccgggtcgttcgaggctttgtccgagagcgactcgtcccccatcctcggtcgaaatcgccggcgaggactccccttgaattcctctgcgagttccggctcgcgggggtcttccccgatcctgggaaggtcgcgtcccttcgacccgtaccagctccccttacgctttgcctttctccaccagtcgctggtccaatgatttcctgtgaggaccacagcgcccccccttccgttcgctcgagctcccccattcctaactccccagcctccgtaagctccgtggaggcgcacttgtctgacttgttagacaaagtgtcttccggagaactgcggccgctgtcccccaccctgccttcttcaggcttttttggccctctgttgccacccactccccctccccgacctaccccctcggccgaaaaggcatctccttcaggcctttcctacctaccctgcagagaagtaaaaatcgcgtccattgcacggccatcccctgcctcacagagggtcggctgcgacgcggaccgaacagggccttcgctgaaccctaattatcagcaaacctcccccccgtctactccgagtttctcccccatagttagaccccctaaattcccccggtcgggcgccaaagtaaattccaagtccaaaccccccggcgtccgaccacgccgtgccaagccaattgagccagggaccgagtcggcatcacccgttgatgtcgacactattagtagttcggttcaggaaccttgtactccagaaaacagaaccccggaatttttttatgagcgaaagtggctcgtgagtattttaaatattcacgagcgggagggatccaatttttttcaatttaaccgggatctggagtattggacgcagttgctttcaggctcccagaagggaggacgcgcgaagcgtgcgtcctacaatcgtggtgcggcgaaccaagcgatgaaaaaccgcgattccggccgtaaggatttcgatccccggccggtagcaggccacagtagtggaggtggcaccgagctcggttcgcggccacgataccctaagggcgcacgtcttcgtgccgacttctggagggacatgaaagggacggtccgtaagttacttgatggttcgaacggtgagcgtcgctgcgggattcccctcgatatcatagagcggaaattccggcaagtatccatgcccggctggatagaccacagacggtacgcggccggcgcgtccccgtccctagtaacccaagctgaaacggatgttgccatcaccagtgaggaagttgaggcggtcctcagtggcctaaacgttcagtccgctccgggctcggatggcctctcctatcgattttggaagggcctcgatcctagtggtcgattgttgtcatgccttttcgaaatcgttaggaggcatggtcgtattccgggcgcgtggccgacttgtagcgtcatcctgctctgtaaagatgctcagggtgacgttcaggacgtgggaaactggagaccgatcaccatctgccgcactctgtacaaattgtacgcggctgtgatcgccagacgtattcagacttgggcgaaacagggcggggtgctctcgcggctccagaaagggttcatgccagttgagggtgtgtttgagcacgtcttcatgttggataccgtcctttccgacgccaagctgaggcgcaagaatcttcttgccgtcttccttgacgttcggaatgcgttcggaagcgtccggcatgaatgcttgctcaaagttcttcggcacttcgatgctccccattacctggttgaactcgtgagggatatttacaccggtgcgacctgccgtgttagatcttcggttggtgagaccggtgatataccctgtgatcgaggtgtcaggcagggctatcccctgtctggcattcttttcaacctggtaacggaggtgctaataccggggctcagtgccgggaatgatggctaccggatggcttgcttaggtggtaagctcactcaagtcctggcctacgctgacgatctggtggtagtcacggaaaaccgtgatcagatgctacgtcagctgggtgtgtgtgaggaattcggccgttgggcaggccttgcattcaatcaacggaagtgtggcctgatcggctggaggacgttgcggggagggaggagggtcgcactggaggatcctctgctccttaacggagtagagatccccctgttgcggcccggtgaacactataaataccttggcgccatgactggcgtcatgagtgttccccgcaccggatcccagctgatcaaggacttccgtgcaaggctccaacgactgtttacatcgttcctcacaccacaccagaagctgatcgctctgaaacggtttctgctgccaagtctcagctttcatctgagggttcgtccgattgcgcggtctgagctgatcgcgctcgaccgtcgcgtgcgcgagtgccttagggtggcgtttcgcttgaccaagccctcgtgtcaggctgtgtttcatacaccgactgacatggatggtctgggtgtcccgtcggtatgcagtgagagcagcatactgacgatcgcccaggggttcaaggtgttaacgtcacccgacggcacagtgtccgcgacggcttcggcgcgcgtgaagctctacgccgctaaatttggcggcctcactgaagcaggtccttcggactgggcgcgttatctatctggtgatgacgtcaacgggaatagcactcgcaaacccggcgctaacctgccttctggtctgtggactcgcgtccgctgtgccagcaggcagttaggtgctgtgtggcgcgtttgcccggaaaacggcatcactgtccgggtgcgtaattctgtgattacctcccgagaccgacggaagctcatcagatccttccacgattgctctaatcagcagtggaaggagcagtggatgcagcaccccaaccaggagaagaccgctgcagcgcatatggcttatgccgatgcgaaccgctgggtgaagcagccgtcggttatggaacctcatacatacttttttgcattgagggcgcgcttgaacctgttacccactagggtttcacgagctatttatagcagggaccaacacccggacattttatgccgacgttgtggtgcgtcagttgagtccctcccgcatgtactaaaccattgtcctcccaatatgagcataatactcgggaggcataatttggtactgcaggaggttctgaacgcggtagacaaaacccagttcaaagagatatccgttgaccgaacggtccccgagcacatgtcggagacaggtgaggccttgcggcctgacatagtggcacggcggaatgacggttccgtcgtggtcgtcgacgtggcttgcccgttcgatcaaaaggcgaactttgatgaggcggcaaaacggaagctcctaaagtacgacaagctttgttgcaatatcgctgcctccacaggtaaacctgtggagtgtcattcgatagtcgtgggctccttggggagcctcgcggagggtctgtccacctccctccgggctttgggaataaccgattttgctcgctctaagcttgtcgcttgccatcaagggtagccaaaagatttggtgttcttggcgagctgcagtcccggcagagtaggcgagatcgtgagctctacaccgcttcacgatttgacgagttcttcttgagtcgatccccaacggcaacgcactccaaatttaacgaccgcatggcgacgccactgatctcccagtcatccgtgctccgagggcacttaaggggaaccgattcactgatgctgcaagttggcgggggcgcactcaccaatggaagatgagggagcccaacgatgccccgaactaccgcaccgtccccagcaccgtgtccttgtgagtaattattttcactaatccagggacggggccatgaactgaactatgtctgcacgctgccccgcctagcctcggccacaaataaatagtcaagccggggcgtactaccaattgattcggatttggcggggcccatcacgcgcctccgcccccacacacaaaaacacttttaaactcttcggttccccaaccactacaacaaagcgagcggcccctcttagatccaattttaaaattttaaatcagtgcactcaacttttttacgtgttgtgttttttgtattttttcccacagattttgtatttttatattatattttatatacacaacactatttttatacactaccttgcactgtcccactttttgtaattatcaccttttaccttttatgccgctcgctgagctccttgcacggatgaccagacaaacttttataaaattataacattgttttaattgtcgcggggtatcagtggcgcccccttgcggccgtgaaagcccttttcaccttaattcgccccttagtccaaatttttccccattgcctgtaaaagtgcgttgccgtcgactcgaactcgtcctttttaccgcctctctgttactgaactatgaccagcttggctgttgaagtcggctttaattcgccggcttcacattatatttttttgttgggtaatctgttttttttcatatataaaaccattcggcttaaaatcaccaatccccatcatccaccctggtcacccattgaaacatctctttttagtcaattattttttcagattacccctcccaaattgtcatatagtttaacaccccgtttgccaagttggtcttttccccatccccttctgtccttccggtaatcccataacattttattctttaattcggccccataaatagtgtaatcttaagacgaagtccccagaggcccggtcccccccttctttgtcatggaccgggccagcccccctgttaccacaacaacccaccattttattctttctttctttttattagtatttatttatattgccgcccaactgtcgtgtcgtggcgcaggggggttccctctgtcggcccagtggacgaccgtctaaaaaacaggcacaggcagcaggcacttatcacccggtacctccgggtaccggaggctggttttcagcgcactgtacgtgatggccaattttattcattgcattttatccgcgtcgtggtgtttgcgtggatgcattaataaaagatgaaattcc

SEQ ID NO: 1085 - DNA, 4394 bp, Schistosoma mansoni; identical to SEQ ID NO: 139
  modified_base (137)..(137): a, c, t, g, unknown or other

SEQ ID NO: 1086 - DNA, 3818 bp, Bombus terrestris
  modified_base (470)..(470): a, c, t, g, unknown or other
  modified_base (508)..(508): a, c, t, g, unknown or other
  modified_base (598)..(598): a, c, t, g, unknown or other
  modified_base (605)..(605): a, c, t, g, unknown or other
  modified_base (698)..(698): a, c, t, g, unknown or other
  modified_base (846)..(847): a, c, t, g, unknown or other
  modified_base (929)..(929): a, c, t, g, unknown or other
  modified_base (938)..(938): a, c, t, g, unknown or other
  modified_base (944)..(944): a, c, t, g, unknown or other
  modified_base (947)..(947): a, c, t, g, unknown or other
  modified_base (982)..(982): a, c, t, g, unknown or other
tcaatagttactcgggggcaggcgggatattggtcttgccttgcccaagtcacactcctacctcctcgtggtaccgccggtaacacgcgcacgtccacatcagcgaggggcgtactcccccggatgtggcggcgcgtggctaaacggagtgtggcgacgaaggagcgaaagactaacaactataacggtcttccgtaacggctacttggagccgtgaataatggagcctatattaaaccctggaactcgttccttcgttctgttgacgactggaacggcaaaggacatgatttggataacaattggaaacttaatatcgaattcacaattaaattgcaaaattcgataataatacgaatagtgcctcggacgcagcgcctctcagtcccggaggcgctgtggcggatttatccgcttcagaggggactacggataacgaccaggctatgtccccggctatgagtttgatnacggtgccgctcgtgggcaatcgggtcgcctgtccagnatgtgagaaaagggaggctaaccttttcttcttaaatctgtcggacctggacaggcacctaacacaacaccacccggatgccccgatctnttggtcntgtatcgactgcgcgaaatgcttcccgaagcttcatggggctagatgccacatacctaagtgtggtggcgctagcagccaggccaggacaggngagttccagtgcgaggcctgtcccatgagcttcgggtcgcgcagagggctatccacccacgaacggcatgcgcaccctgccgtcagaaatattaaaagaaggggagcggaccccccagaagaaaatacaaaatcttggaaagtagaannggtagcacgcttgaaggggctatgggaaatattcaaagaccataaatatcccaacaaagaaatcagcaaattcctcaccacnaaaacggtngatcanatnaaatatcaaagaaaaaagctaaacttaattggtgnggaaagcccccaagaggctacctcactggcaacagagggagggtgcgatctcgttagttcaggcaatgccagttttggctcgcctgtaggccgcaacgagaacgaagaagagctcatccacgaatggaagctctcgctaaaaaacgaaataaataagccaaccgaggtgccccctattttaaaggaggtttacaatcggctgatgttaatctgggaagagcaccaagatgatcgagactctctaacggagagtctcgatcactttatacgcacagctctatacgagcttataaacaaaataaataaaaaccaaacggatttaaaaactaaaagagcagctaaaacaaaaagcccaaaaaataatagaaactccaggaagcgattctcatacgctcgttgccaggagttatttcacgaatgcccaaggagactggctgatgccgtggtcaataacgatcaggcatatctcgaaccagccaggcaacctcccggatcagaggaagtgagggggctctacgaaaagctgtggggacaagtgggttccacgtacgtcccggctccagttacgagagtccccaaactatccctatccgagatcttcccgccgatagcggctgaggatgtgggggagagaatcggcaaaataagaaagaaagctgcggcaggaccggatggattacaaagagatcacctaactatccccggcctgcctatcataatggcgaaaatctataatatactcgtatattgttcttattttccctccgcatggaaggagaatagaacaactcttattccaaaaataaataagccatgcagcctggtcgagaactggcgaccaattactattagtccgattctaggccgaatcttctcctccattatcgacgggaggataagaagaggcactgtattaaatatgaggcagaagggctttacatctgaaaacggatgtaaaattaacatcgaattattaaattctgccttaaactatagtaaaagaaatagcggcgggatattcactatcgtggatatctcgaaagtttttgatacagtgcctcatgcagccttaaaaccttgtctggcaaaaaagggtgtgcccgcccttatcgtcgatttgatcgacgaaatgtataaaaacgtaaaaactactataaaaactaaagatggcggggtcgagattatgatccgccgaggagttaagcaaggcgaccccctatcgcccttactcttcaatttatgcttggagccactgctggaagagatcgaggagcaagccagtggaataaatgttagcgaacatcgtaaagtatcagttctggccttcgcagacgatatcgttctacttggagcggacgcgagggaagcgcaacaccaaataaacgtacttaccgactacctgcaaagcctcatgatgaatctatcaattgaaaaatgccaaaccttcgaggttgtggccaaaaaggatacctggttcattaaggaacctggacttaaaatcgggaatcaaataatgcctactgtagatcccgacgaggctttcaaatacctgggcgccaaaattggtccctggaaaggcgttcattgtggtgtaattgttccagaacttctgagcgtggtgaaaagggtgaggaaactctccctcaagccgggccagaaggtggaacttctaactaaatacatcttcccccgctacatttaccatctacttgtaagtccgccaagcgataccgtccttaaactactagacagcgaggtcagacaagaagttaaaactatcttacatcttgtgccttccactgccacaggcttcttttacactccaaaggcctgtggaggaataggaataccgaggtttgaacatataatcaaactcggtacccttaaaagtgcaataaaaatcgcaaactcgatcgatccagcggtcgctggcctaatcgatgatgcagccataaaaaagttaaagcaaacggccaactccttgcggatcaattggccagcctccttggaggatattgaaaaagctcgtaaacgtctaaggaaagagcatatcagccaatgggctgatttaaaatgccagggacaaggcgttcctgattttatcaaaaataaaactggcaacctgtggcttgaggaccatagtctactcaagccatcgagactcatcgatgcccttcgattaagaacaaatacctttggtacaagatcggtgctggcacgggccgacaaaaatattgatgtaacatgtcgaagatgtcgtgcccagcccgagacccttggacacatactcgggctatgtcagcacactaaaggcttaagaatcaaaaggcacgatgaggttaaatccctcctcgaaggaagattaaaaagtaaaaagaacaacgaagtatttgtagagccgacgattaaggccggaggcagtttatttaaaccagacctcgtaattaaaaacggggaaagggttctcgtggtcgacgtaactgtccgctacgagaacaaaaactacctggccttagccgaaaaagaaaagatagagaagtatcggccatgcctaagggcattaaaagaaatatttaacgccaaaggaggagagattcttccggtggtcttgggtagtagaggcactatcacgcctaacaccgagaaagtcctcaagcgattgggaatcgctaacaatgatataaagacaatactcttaaatgtattaagaagctcgatagagctgtgtaatatattcattgatgactgaaaacacgataacgattatgaatcaaaataagaaagtaaacatcccagaaattgtctacgtcttatttgttatctatttatttgttta

SEQ ID NO: 1087 - DNA, 5699 bp, Crocodylus porosus
aggcgtctcctttaagggcaacggtctggttacgcggtcgcagcagkcttgckccaggtacctccwcgtggttcccgccgggtgccgmagmcccaggsctgtcggtagctcgatcctggcacagtamggccaggggagtkcttccttgctgcwggtgccccacaagcgtktggcagsmcmcctgcttcwtcgcaamaatmasagkgtsmtcagtagtcggccccgccgctagccaaaactgttcgccacscagttacagatggtgcctgtgctgacckgkkgccccgtgggctcggwggtgcaggggwggccggcccatggctgggccagacstgggccktggagcccgctcccamcccagagttccccctcaamgccgccaggkcagmamcakccggggagkgmcacggccccggccgtgagtcccccccggtgcwgaggcccggggccgataccaccacccccggtgmgagmgcgcccgccagggtgaaccaccctccamcagggttttcctggtgasgctgcctgactcaaaccckccgtgcccgatttgcggggaccacgtgsgtwaacwctccgtgctggccctccactgcgtggagggccacgwgtgggcgsatgtgcagtaccagtgcacccattgtggcatcctctgccacatcccacgttgccaggggagggtgcmkgagcwgaccgggaaggactkggmttgtcctgagtgccctgcctccttcgatgagaaagcwggcctatcgcagcacaagcggcacacggtaacacamagtgwkgaacgggttgcaggkwacctgttgagggctkgtttaaggcacgggtgctggtcggtggaagaagaggaaactctcacccgcctwgacgcgatgttccstggcgcccggaacatcaaccagctgatcgctgctgagmtggtwtcgaagatgcstaagcagatcagcgacaaatggaggtwgctckstctgwgtcctgagcagaccacatwgggtggtgakgctgagtckgcctccgtggtgsaggwwgagtccatgactccggagatggaagcccaaagcccagctgamccgcctgggaaaatcaggaagattttcactggacaagatgggcacgccggtggctgaagagggggcaggktctgtcagacaaggtgcaagaagtcctgggckcgtgggtggagggtcaacccaggattcmtgcctgggtcgackcmgtctcccttgatgttttgactttgttcttgggggtgcccccgggaccgcagagggctccgagcaagaaggggcccamggagggtggcaaaccwacgtcctggatgaacaaacgtgccatcaaatggggcacattccttcggtaccagcacctgtttggtgccaacaggaagctcctggcggccmtcatcctggatggtgctgascgtaatcagtgsaccctcctgctwgaggaggtcttkcaggmctacckaggaaagtgggaggccgagccgcctttcgagggtcttggacggtttgggstccammgggatgtggatagcttcgcattcgaggccctgatcactckggaggaggctgtcaagcacatgatggmaatggccwmsaamtcggctccaggtccggataagctcaccctgagagatctgcgccgcgckgaccccgagggagatgctcttgccgaactgttcagcctgtggmtgatcactggcgtggtcccggacagactcaaggagtktcagtstgtgctgataccaaaggcagtggactttgagaagctgaggcagctgggcaactggcgccccatcactatcgsgtccattgtkttgcagctattmtcacgggtgctgaccgcacggctcaccgcagcwtgccccataascccccaccagcagggkttcatmtcggcacckkggtgtgccgaaaacctgaagmtgcctgagctcatcttscgsaaggtgaagcamgacaggcggccgctgggggtggcattcgtggatmtagcsagggcsttcgactcggtatcgcacgacmacatttcwtgggtcctaaaggccaaaggggtggaccaacacatcgtgaatctcatwgaagattcataccagaaggttaccatgagagtacaagtgttcagtggttccaccccwcccatcagcatcaaawccggggtcaagcaaggcgacccgatgtcmcccctsttgttcaacattgcgatggaccccctgatagscaagctcaagacagtcaggcagggagtgaaagtcgggagtgcttccctgaccaccctggcatttgcggatggcctcgwmctgctgaktgactcctgggagggcatgcaacacaacatcacgacatcctagaggacttctgcaacctcacgggcctacgagtgcaacccamaaaatgkcaggggttcttcttgaatccgamatgcgactcctwtacggtgaacaactgcgmggcctggaagatwgccggccgtgmsatcacgatgctsgggccaggcgagccgacacgatatctgggcttgaakgtcggtccctgggttgggatwggcaaaccagatttgggtacgcaactaakctcctggctcgagaggatggggactgccwcgctcaaaccaatgcagaagctctttgctggtscagtatkccattcccaggctgcgctmtcaggccgwtttatgcgaacmccggttgggtggcctcggaggctctggattccatgagccgaagaaakgtgaaggagtggttccacctacccgcctgtaccgackgcctcctccastcccgccaccgggatgggggcctkgggttgctgcgcctggcgagagmcwttctggcagcgsaagtgaggaggccgattcgtgtagccacctcatctgatgaagtcacgcggaaagtatcctacgcatgtgggataagtgatgaagtggagcgkctctgkttggcmagwgggggagacatstccaatgtcccgaggttcgaggatcctgawgccccgaagtctscakgggtgcagggcccccatgaggctgcccaggagacaccacgtgttgtccggacacaggcgatcccctggccctccaactggagagccgaggaacactccaaatgggcccaactcagctgtcagggagagagggtggagttattctgcaatgatccagtcagcaatggctggatcaacagtcggggacaactggcggaacgcctctggatcatggccttaaaactgcgttcgaacatttatcccaccagggagtttcttgggagaggccaggcaggtaccaacataggttgccggcactgtacacaccctcgtgaaacattagggcatatcctgggcatatgtcctgccatgcaggaggcacggatcctccggcacaacaagctgtgcaagatcctggcagctgagggcaaaaactgtgagtggacagtgtattatgagccgcacctacataacgcagctggggaactgcgtaaacctgacctcatttttgtccgagacggtaccgctctggttgtggatatcactgtgtggtatgaagggggccccgcaaccctcctgtccaccactgcagaaaaggccacaaaatacctggatctgaacacacagatccaggagctcacaggggctgagcaggtcacctactttggcttccctataggagccaggggaaagtggcatgctgacaattggcgagtactgtctgaactgggattgtccaactcccggaaggagcgggtcacacggctcctgtcgtggcgagcactgctcgggtcagtggacatggtgaacatctttgtatctaaacacaggcaggaaaacctattggatgagcactgcaccccagctgagcaagttgtgagttcttatgcgagttgaatcccactctggggacccccaaaaattagaaaaacccaaaacagttgtgtttaagtgtgttcttgtttgtccctttggcttcacctccaagttgcgatcccccatctcccctgcgctgtctttctgaatgaccagtggtgttgaggctggtgtgacctcggtcacctccaaggccaagtgccctggccccgagtaggaccaggtggcccagcttgctgggcacccgtcaccgcccagggcaaatggaagggatctatcctgaccactaccaggctaagtgtggtgctgcctagcctgccgtaaggtcaagcgccctgctgccgctcgggtakcagtcctcgttcactcgtccctcctagtaccctccgcmtctgcgcttctgctatccactgtggccggwgatgccgaggwtgswmcawcctcgacacctccagggccaagcgccttggccmcaggtaggacctggcacctgcccagggggccagacactgcctgcggcaagggaaagggagccgtccctgaccgttaccgggcttgatggtgctggctagcccgccgtatgtcaagcactccacagctgctcgagttcgctggcttcaccttcatcccwcctagtgccttccgcctctgcgctattttcgtcccgactcgtacctccccacctctgcgctacmgctatccctgmaaggaccaagtgggcaggggsgttcgccccccgcccgcaggaggctcggcgtatccgtggcktcwtgcctccaccgtcttgtgccgctagaggggtacctcmgagaccggcgcaacacgaccttgacgsttagacagtagggtgmaacakccctgctgcaggcstgaagggccaaacggctgtgccatgagaggggaaccttgaagaccgggscagtcagccagttagtcagttgggcgaaacaatcccagctgcaggcccammagggctgtcaggtgagggggtatccccawccaccccccgccgccgactacggaggcakgaagtccctagtgacttckgacccccacgtcttgtgccgggagaggggaaccttgaagatcggggcaagccgcacttgatagttagccagtckggtgaaacaatcccagctgcgggtccgaaagggccgactwccaggcgaggggggcctgcggaaamccccctccatggtacggagktctggcgtcctmaccgacwccttgccaccaacgtcttgtgccgggagaggggaaccttgaagatcgggscaagctgcacttgatggttagtcagtcgggtgaaataatcccagcwgcccccgctgtgactgctaagmcwggtccccaaggggcatgaggcatstgcgctgagccggsaggggtgacacmcggcgatcggcgcagcacakastgaagggaggcacttgctgagactgcttctgaggccccagacttggggtggtgcagccttgtctggggtatggtacagcaccctactgctccctttggkcagcagaattcgtcccgacctcttacccacccgagtctgcgccttgttccgctatcctgcatctccgatccacctcgctgtctccccgctgcgctgcttttctctcaagtgggttaaatcttgtcatgattacctcccacgtttccgctcaagggcaatgcccaamatgacggggatcgctggtgcatggcagtcatgagaccatccggaccctccggtggtcgctatagtcattttktgttgcatggggcatsctgagtcacttaaccgaaagactcwaaataactcaaaagaggkamcctctgsggttcggtaaa

SEQ ID NO: 1088 - DNA, 3550 bp, Drosophila willistoni
gaagctgggtcggatgagcgcagaaggggtgttctttggaacactgtaattcataagtcgtaagtctgatcaagtcgactcgaaacctcctcgtggtgtttcctgggtgctgttgagttcctagtctctaggttcttttcagtagctaattcgagcggcgaagcaactcttggggttaccggccccttgagccaagaagcgttggtacagaatcaaataataatagtcctcggagcaatatcactatcacttcagcgacttcacgtcctggagaccaaccgagagaggctatagcagtggtaaatctcgcgggagagattccctgtgcagtatgcgggcgcctcttcaatactagaagggggctcggtgtacacatgtcacatcaacacaaagacgaactagatacgcaacgtcagcgtgaagatgtaaaactccgatggagcgaggaagaagcgtggatgatggcgagaaaggaggtggagctcgaagcaagtggtaatttgagatttcctaataagaagctagcggaagtatttactcaccgtagctccgaagcaattaaatgttttcggaagaggggtgaatataaggcaaaactggagcagatcagagggcaatctactcccaccccagaagcgttggactctattacctcacagcctcgccctagtttactcgagcgaaaccaccaagtatcatcgtcggaagcgcaaccaatcaatccatcagaagaacagtcgaactgggaaatcatgcggatactacagggctatcgccccgtagaatgtagtccccggtggagagcccaggtcttgcaaactatcgtagatagggcgcaggccgtagggaaggaaaccactctccaatgcttatccaactatctcctggaagtatttccattaccaaacgaaccacacaccatcggtcggagcaatttgcgaagacctcgaactaggagacagttaagacaacaagagtacgcacaggttcagcgtcgttgggataagaatactgggagatgcattaaatccttgcttgatggaacagatgagtcggttatgccaaaccaagagataatggaaccctattggaaacaagtaatgacgaatcccagcacatgctcttgcgataacacaagattccgtatggaacattcgcttgagacggtttggtcagcgataacgccacgcgacctgagggaaaataagttaaagttgtcaagtgctccgggtcctgacggtatcactccaagaacagccaggagtgtacccttaggcattatgctacgcataatgaacctgattctctggtgcggcaaaataccattctctacccgactggccagaactatcttcattccgaagactgtgacggcaaatcgaccgcaagactttcgtccaataacagtcccctcggttttggtcaggcaattaaacgctgttctggcttctcgattggcttctaaagtcaactgggatccaaggcagcgcggtttcctacctaccgatgggtgtgctgataatgcgacgttggttgatctcattttgcgggagcaccataaacggtggaagtcatgttaccttgcgacggtggatgtcagcaaggcttttgactcagtatcacaccaggccattatcaagactttacaggcctatggtgctccaacaaactttgtcagcttcatagaagaacagtataagggcggcggaacctccctcaatggggcaggatggagttcagaggtgtttatacccgcgcggggcgttaagcaaggtgaccctctgtctccactattatttaatcttatcattgatagattacttaggtcctaccccagagagattggtgccaaagtcggaaataccatgacaagcgcggcagcgttcgcggatgatctggtgctatttgcggaaactccgatggggcttcaaacattgttggataccacggtaggcttcctagcctccgtgggactctcccttaatgctgataagtgcttcactgtcagtataaaggggcaagccaagcagaagtgtactgtcgtagaacgacggagcttttgtgtaggtgagcgcgagtgtccttcattgaagcgtactgaagagtggaagtatttaggtatccggttcactgcggatgggcgggctcggtatagtccagcagacgacctcggtccgaagctgttaagattaacaagagcccctctgaaaccacaacagaagttatttgcacttaggactgtccttatcccacaactctatcaccaactaacacttgggagtgtgatgataggcgtcctaagaaaatgtgacagattggtacggcaattcgtaaggagatggttagatctcccactggatgtaccagttgcttactttcacgccccccacacttgtgggggtctcgggattccgtcaattagatggatagcaccgatgctgcgtctgaagcgattgagcaatattaaatggccccacctcgaacaatccgaggtagctagctctttcattgacgacgaattgcaaagggctcgagatagattaaaggcggaaaatgtgcagctgtgttcgcgtccagagattgactcgtatttcgcaaatagattgtacatgtctgttgatggttgcggtctccgtgaagcaggtcattatggcccgcaacatggatgggtgagtcagcccacgcgcttgctaacaggaaaggaatatttgcacggtgtcaaattgcggataaatgccctaccctcgaagtctcgtacgacgaggggaaggcacgaattggagagacggtgtcgtgcaggatgtgatgctcccgagacaacaaaccacatcttgcaaaaatgctatcgtacgcatgggaggcgggtagctagacacaacagcgtagtaaatgccgtcaagcggggacttgaacggaaaggctgcgttgtccatgtcgaaccaagtctgcaatgcgactcgggcttaaataaaccggacctggtgggaatccgacagaatcacatttatgtgatagacgttcaggttgtgacagacggacattccttagaccaagcgcaccagcgcaaggtcgaaaggtacgacagagctgacataagatcacaaatgcggcgatttttcggagcgacaggtgaaatcgagtttcattccgttacactcaactggagaggaatctggagtggtcagtcggtaaaacgattgattgcaaaggatctcctcatcgctgaagataccaaactcatcagcgtcagagcagtaaatggcggagtgacgtccttcaaatatttcatgtattgtgctgggtatactcgaagctagatgtactaacctctagcttttcttatacttttgcctgctaccttggcattacatctaaaaaggtacaaacatcgcattgtcataaagaggtggttttagtacgtaggcgctgtgggacttcattgtcccggtgatgcagtgaatcgtgcatacgagattgtccagtagttggttgctcgtatctttagaagatttccttcctcggcgatcaaaaaaaaaaaaaaaaaaaaaaa

SEQ ID NO: 1089 - DNA, 5974 bp, Gavialis gangeticus
aggcatctccttkaagggtaatggtctggttacatggtcatagcaggtttgtgtcaggtacctcccagtggttcccgccgggtgscamagccccagggctgtcggtagctcgatcctggtacagtacggccaagggagttcttccttgctgtcgggtgcctcgcaagcacktggcagccccaatcgcttcattgcgaaaaacacaaacgtcctaaggggatgatcagctagtcagttctgccgctagccaaaactgtttgccacccagttacagatagcgtctgtgctgaccagctgccccgcgggcttggggtgcagtggaggccggcccgtggccaggccggacacgggccgtggagcctgctcccagtccagagagttccccctcggaagctgccagggcagcaccagccggggagggccacggccccggtcatgagtccccctcggtgcagaggcctgaggccgataccactgcccctggtgtgagcgcgcccaccagggagggtgaaccaccctccaccagggttttcctggtgaggctgcctgattcaaacccgccgtgcccaatttgcagggaccatgtgggtaaaccctccgcgctggccctccactgcgtggagagccatgcgtgggcggatgtgcaataccagtgcacccattgcaaaaaggtcagtgctaacaaacacagcatcctctgccacatcccatgttgccaggggagggtgcccgagtggaccgggaaggactgggcttgtcctgagtgccctgcctccttcaataagaaagttggcctatcgcagcacaagcggcacgtgcatccggtaacacgtaatgtggaacgggttgcagggagcctatcgagggctggtttaaggccccagaccagacgcgggtgctggtcggtggaagaagaggaaactctcacctgcctagacgcgatgttccgtggtgcccggaacatcaaccagctgatcgctgctgaaatggtaacgaagatgcctaagcagatcagtgacaaacggaggcagctcggtctgtgtcctgagcagaccacattgggtggtgatgctgaatcgacctccgtggtggaggaagagtccatgactccggagatggaaacccaaagcccaattaacccgcctgggaaaatcaggaagatcctggcccagagggcacgccggtggctgaagaaggggcagggtctgtcggacaaggtgcgagaagtcctgggcgcatgggtggagggtcaacccaggattcatgcctgggtcgactcagtctcccttgatgttttgactttgttcttgggggtgccctcaggaccgcagagggctccgaacaagaagaggcccaaggagggtggcaaaccaacgtcctggatgaacaaatgtgccgtcaaatggggcacattccttcggtaccagcacctgtttggtgccaacaggaagctcctggtggcsatcgtcctggacggcgctgaccgtaatcagtgcaccctcctgctagaggaggtcttccaggcctaccgagaaaagtgggggctagaggaagtccttcgggcctaccgaggaaagtgggaggtagagtcatcttttgagggtctcggacggttcggggtccgccgggatgcggataacttcgcattcaaggccctgatcactcctgaggaggttgtcaaacacatgatggcaatggcctcgaaatcggctccaggtccggataagctcaccctgagagatctgcgccgcgctgaccccgagggagatgctcttgccgaactcttcagcctgtggctgattaccggcacggtcccggacggactcaaggagtgtcggtctgtgttgatacccaaaacggtggaccgggagaagttgggccagctgggcaactggcgccctatcacgattgggtccatcgttttacggctattctcacgagtgctaaccgcacggctcgccgcagcatgtcccatcaacccccgtcagaggggtttcatagcggcgccggggtgcgccgagaacctgaaggtgcttgagcttctcttgcggaagaggaagcgagacaggcagccgttgggtgtggtatttgtggatctagcgagggcgttcgattcggtgtcacacgatcacatttcttgggtcctaaaggccaaaggggtggacgaacacatcgtgaatctcatcgaagattcttaccagaaggttaccacgagagtacaagtgttcaatggcgtcacccctcctatcagcatcaaaaccggggttaagcaaggcgacccgatgtcccccctcttgttcaacattgcgatggaccccctgatagcgaagctcgagacagacggacagggagtaaaagtcgggagtgcctccctgaccaccctggccttcgcggatgatctcgtcctgcttagcgactcttgggagggcatgctgaagaacatcagcatcctagaggacttctgcaacctcacgggcctacgagtgcaacccaaaaaatgtcaggggttcttcttgaatccgacatgcgactcctttacggtgaacaactgcgaggcctggaagatagccggccgtgagatcacgatgctcggaccaggcgagtcgacacgatatctgggcttgaatgtcggtccttgggttgggatcgacaaaccagatttgggtacgcaactaagctcctggctcgagaggatagggactgctccactcaaaccgatgcagaagctctctttgctggtgcagtatgccatacccaggctgaactatcaggccgattacgcgggcatcggcagggtggccttggaggctctggattctatgaaccggagaaaggtaaaggagtggttccatcttcccgcctgtacctcggacggtctcctccactcccgtcaccgtgacgggggtcttgggttaccgcgtctggcgaaagccattccggaagcgcaagtgaggaggctgatccgcgtagccacttcatctgatgaagtcacgcggaaagtatcctacgcgtgtgggataagtgacgaagtggagcggctctggttggcgaggggtggggacatgtccagtgtaccgaggttcgaggatcctgaggccccgaggtctccgggggtgcagggcccctgcgaggctgcccaggagattccgagcgtagtccggaagcttgcgatcccccggccctccaactggagatccaagaaacactccaaatgggcccaactcagctgtcagggagaggggatggagttattctgcaatgatccagtcagcaatggctggaacaacagtcggggacaactggcggaacacctccagatcgtggccttaaaactgcgttcaaacatttatcccaccagggagtttcttgggagaagccaggcaagtaccaatgtaggttgccggcattgtacacaccctcatgaaacactagggcatatcttgggcatatgccctgccgtgcaggaggcacggatcatccggcataacaagctgtgcaagatcctagcagctgagggcaaaaagtgtgagtggacagtgtattatgaactgcaactgcttaacgctgcaggggaactgtgtaaacctgacctcatttttgtccgagacggtaccgmtctggttgtgaatgtcactgtggggtacgaagggggccccgcawccctcctatccaccgctgcagaaaaggccacaaaatacctggatmtgaacgcacagatccaggagctcacaggggctgagcaggtcacctactttggcttccctatwggagccaggggaaagtggcatgctgacaactgkcgagtactgtctgaactgggattgtccaactcccggaaggagcgggtcgcacggctcctgtmgtggcgagcactgctcgggtcagtggacatggtgaacatctttgcatctaagcacaggcaggaaaacctatcggatgamgcactgagccccagctgagaagttgcgagttcttatgcaagttgaataccactctkgkgaccccaaaaaawwaaaccccaaaacagttgtgtttaagtgtgttcttgttcgtccctttggcttcacctcsaagttgcgatccccccatctcccctgcgctgcctttcagaacggccggtggtgtcgaggctggcgcgacctcggtcacctccaaggccaagtgccctggccccgagtaggactgagtggcccagctcgctgggcacccgtcaccatctggggcaaatggaagggatctgtcctgaccactaccaggctaagtgtggtgcggcctagcctgccgtaaggtcaagcgccctgctgccactcaggtatcagtcctcgttcacttgtccctcctagtaccctctgcctctgctcttttgctatccactatggccagtgatgttgaggttggtgcatccttggtcacctccagggccaagcgccttggccacaggtaggacctggcacctgcccagggggccagacactgcctgtggcaagggaaagggagccgtccctgaccgttaccaggcttgagatggtgctggctagcccaccatatgtcaagcactccacagctgcttgagtttgttggcttcaccttcatcccacctagtgtcttctgcctctgcactattttcatcccaactcgtacctccccatctctgcgctcctgctatccctgcaaggaccaagtaggcaggggggttcatccccctacctgcaggagactcagcatatccatgacttcttgcctccaccgtcttgtggcgctagaggggtacctcagagaccggcacaacatgaccttgacggttagacagtagggtcaaacaaccctgctgcaggcccaaagggccaacagctgtgccacgagaggggaaccttgaagactggggcagtctgaccatgctggttagtcagttgggtgaaataatcccagctgcaggcccaaaagggctgacagtcaggtgagggggtatctccatctgctccccactgccaactacggaggcatgaagtccgtagtgacttctgacccccacgtcttgtgccatgagaagggaaccttgaagattgggacaaaccgcacttgaaagttactcagccgggtgaaaataagtcccagttgcgggcccctcggggctgacagtcaggtgaggagggctgcaaagcccatctcctgactccagaggcctggcgtcctaaccgacttcttgccaccaatgtcttgcgccaggagagggcaaccttgaagatcggggcaagccgcacttgatagttagccagtcgagtgaaacaatctcagctgcgggtccgaaaggactgacttccaggcgaggggggggcctgcggaaaaccccctccatggtacggaggtctggcatcctaaccgacaccttgccaccaatgtcttgtgccaggagaggggaaccttgaagactggggcaagccgcagttgatggttagtcagtcgggtgaaataatcccggctgcaccctgctgtgactgctaagcccggtccccaaggggcatgaggcatgtgcgctgagacgggaggggtgacatctggcgatcagcacagcacagactgaagggaggcacttgccgagaatgcttctgaggccccagacttggggtggtgcagctttgtctcgtgtatagtacagcaccctactgctccctttgggcagcagaatttgtcctgacctcttacccacccgagtctgcgcttttgttccacctcgctgtctccctgctgtgctgtttttctctcaagtgggttaaatctcaacatgattatctcccacgtttccgctcaagggcaatgcccaacatgacggagatcgttggtgcatggtagtcacgagaccatccggaccctccagtggtcgctatagtcattttgtgttgcatggggcatgctgagtcacttaaccgaaagactgtaaataactcaaaagaggtaccctccggggttcggtaaa

SEQ ID NO: 1090 - DNA, 4425 bp, Ixodes scapularis
gttccaaaggaaggcactcctttggttcgtgatgagatgttcatggtgcttgcctagctggagaaatccgactcacacctgcacgtggtccctgccgcctgccagtatgccgaggaaacgggtgcaacttaatccgtggatactggtagcaacgtgagcaacggtacggtccttcgcggaccaccctgggcgttcgggttgccagcccgttcgcccgaaatatcttggccctgaaactaaaagaaaaatgcaatgcaccagccgactggctgatgcaccaagatttgcccgagtgggcgtcgagggtgaaggtgtcggtgcgtctggtaacggcactgatgcgcagttatggtatggctgcacgggctgtgacgaagccttctcgtccctgcgaggactgagaattcatgcggcccaaaagaaacatggaaaccaagatggccttctccgcctgccggcgggacggccccgaaaacgacgagtggggaagagcaccacagcgggtgcttcggaccgggtgaccacggatccagtgcctgctccagttcctgaatctcctgggctgctgcctgggctacctggaccatcgctgcctgggtgctcggacctgccgcctggggtgctgcctggagggtggtctgcatcacctgggcctctctcctggcctccttccctggatgccgggcctctgcctggaccttcaagagtatcacctggaccttcaagaccttcgcccgggaagccgaccgggcctccttccctggatgccgggcctctgcctggaccttcaagagtatcacctggaccttcaagaccttcgcccgggaagccgcccgggacgcctgagccgctgcctggatctcctggcggtcggcgcggggtgtccccgggacagcccgggtcacggaccgacccctcaagctctgctggcgccggacacttcgtatgcccgcagtgcagcagagccttctcaagcaagattggcatgtctcaacaccaaaaacatgcccacctcgaagaatacaacgcgggcattaacatcacccgtaccaaagcccggtgggaccccgaggagacctatcttctggcccgcctggaggccaccctcaacccagaccacaagaacatcaaccagacgctgcacgccgcgctgccccgcggttcctgtcgaaccctggagagcatcaaggcccaccgaaagcaggcggcttacagggacctggtgacgagcctgcggtcagccagggagagcagcgaggcgcagcacgttccggaccggcccctggagaccccggagccccagacaccagcgaaccctcaaagagactcgaagcaggcagtcatcgaagcgctgcaatccctcatcggccgagcaccaccaggctccttccagggagcgcgtctctgggacatcgcgaggcaagccacaagggggacgaacatcctcccactcctgaacagctacctgagggatgttttcaccctccccacaaagccaacaagaaagaaacctgcagtgcggcccgcccggagccgcagaaaacaaaagaaacaagagtatgccagaacacaagatctattcaggaaaaagcagtccgactgtgccagggcggtcctggacggccccacgtcgtcatcggtccctggaacgggcgccttcctgcaaacctggcgagagatcatgacggggcccagccctgcactcgaggcaccgcctctacctacccggggggaagtcgacctgttcttcccggcgacggcgcaagagatccagagcgctgagatagccgtcaactcggctgctggacccgacgggttctcagcccgtctcctcaagtccgtcccggccctcctcctaagggtcatggttaaccttctgctcctcgtccgacgtgtcccggcggccctccgggacgcgagaacgaccttcatcccgaaggtccccgatgcagtggacccctcccaatttcgcccaataacggtggcctccgttctccagcgcctactacatcgcatcctggccaagagggcgctggaggccattcccctcaactttcgacaaagagcctttcagccggtggatggctgtgccgagaatatatggctgctgtccaccgcgctcaacgaggcaagaaccagacggcgcccgctacacatggcgagcgtcgacctaaccaaggcattcgaccgggtcaccacggatgccatcctgaggggcgcaaggcgcgccgggctgtccggggagttcatcggatacctgaaggagctctacacaacatccaggaccctcctgcagttccagggagagagcctgcttgtcgaacccacgaccggcgtgcgacagggcgacccactgtcgcccatcctcttcaacctggtcctggacgagtacctctcctccctggacccggacatctccttcgtctcgggcgacttgcgcctcgatgcgatggcattcgctgacgacttgatcgtctttgcctcaaccccagccggcctgcaggatcggctcgatgccctcgtcgagttcttcgacccaagggggctcagggtgaacgtgaagaagagcttcacgctatcgctgcagccgggacgagacaagaaggtcaaggtggtgtgtgaccagatcttcaccatcggaggaaccccactcccagcctccaaggtcgcaaccccttggcgctacctggggatgaccttcaccccccagggctcaatcaacaagggcaccagcgagcagttggacctactgctcacgagaaccagtaaggcccccctcaagccacaacagaggctggtggtcttaagaaactacctgctcccgaggctataccatcgcctcgtgcttggaccttggtcggccgccctcctactgaagatggacaccaccattcgaggagccattagacgctggatggatctcccgcacgacacaccgctgggtttcttccacgccccagtaacggagggaggcctaggaatcaactccctgcgagcatcaattccagccatggtgctccaacggctggatggacttcacttcagcacgcatcccggagctgaggtcgccatccagctgccgttcctgacaggactccatcgaagagcggaagcggcggcccaataccagggacagagactactgtccaaagcggacgtccaccggatgtggagcgcaagactccacgggagctgcgacggaagaccccttcgggagtccaagagagtgccggctgcccatcgttgggccgcggaaggcaccagactactctcgggaagggacttcatctcgatcacgaaactcaagataaacgcgctacctacactcgagcgcaccagccggggccagcacaaggacatccagtgcagagctggctgccaggctgttgaatccctgggccacgtcctacaagcttgccatcgaggacaccgtggccgaatccggcggcatgataacattgcccgctacgtctgcggccgactgacccagattggctgggcggtgaagtgggagccccactactctgtcgctggaaggaccctcaaacctgacatcgttgcccatcgtggagccgagactgtcgtgctcgacgcccaggtcgtcggcaccagcatgcgactgggcttccaccacgctcaaaagaaagaaaagtactctctcccagacctcctccaccaagtctgcgagggacggagagacgcagcccgggtgtcaacaatcaccctcaattttcgaggtgtttgggcacctgagagcgcccaggacctgaagtccctgggcctgacggacaacgacctaaagcttctcaccgtccgctgcctccagggcggcgcgcagtgtttccggctgcaccgccgaatgaccaccgtggtgaaggccacgggcgatgaagccaacgccctccccgcccattcgggcttgccgccaacacagcttggtggccgaaccctgggtccctctgcccacaatcagagtgcaagaactacttagtgtgacggagtcctcaagcccccacaagtgcctgccaggtggcaggaaagggcaactactggtgagcgacccaagcaaggcggagccaagaccaagctggagccaagagcaactccaggaggcaggggtggatatcaagagcaaccccaagggacacagaccacgggcaactactggtgagcgcccaagacaggggtggatattaagaacagccccacaaagtgttacctatattaacaataaagttgaagcctcaaccacgcattgcgggttagatggcgtggcttggcccgccgccatgatgagctggaaccctccacctggtgggccgcacgagaccaccggctctttctactaaggccggtctccgtgactgcggttgggataaactccaagcactgagcggtaaaaaaaaaaaaaaaaaaaaaaaaaaa

SEQ ID NO: 1091 - DNA, 4740 bp, Mnemiopsis leidyi
tgggggccccttggacttgctccctggggcaggacaccagtgaaaggagatcctcaagacaggacagagagacaggcacaccaacccttcgaacctgaggagacacccagatctggttaccccattcctgtaaccatggttgctctccgtgcgctgttaaggaaacccagcctagtaccctcggggaaaggttgcgtagtacttagcagtgtgcggatcaaacctctaccggtctctctagcgatgaaagtttctccgactggaacttgagggactggctagcccagctagcctgtagagcaatgcgtatacgatgccttggcgacaatggcgaccgctgcttagcagacggaggttagtgaaagggcgacttgctgttcatagtcacgtgagtcgtctagaaactgcaccgatgctgccctctgttccaggagaaggacagtggaggactaaatcgtagcgcgagcggtgttatgtcgaacactagccactcgaaacttaacctcaaaatggataataaactcaagactagtctcgagactccctccggagtccgagcagattcgataataacgcgggtgaggaccagcagtaaccgtggtgaacacagcaatggtgtcacgtatccccggtgcgaacagggggttgcgcctctggatacgcatggggggatatgtgacgctcctccacaggtgacggttcccgccactgagacggataaacagaaaaaatgtgaatactgcgagttcacatacctgaaaccgagacagataggaacccacatgagaaaacggcatccccaggaatggaacgacatcaaacggaccaaattcctgagcgaaaagagacaaaaacgttggcttgacgaagacttcgagcttctctgcataggccaagaggaataccttgtgctatcctcgattggcaaacagggcaaagggatcaaccagtatattcaaaccaagtacttcccaacccttagtacagatgctattaaatctcaaaggaaatccagacggttttcagagtacagcgaaaagagatcacgtgaactccaaccttgcaataccagcagcgaccccgaagaacttccgaatgaagcggtcaccgaaaacagtccgctctcttttgatccacttgaccgagatgttgtaaagaaaataagctccaaagatcacggcgatcagatcctcttagtacaggagcacctcatcaacggacggtatcaagaagcgaacacgttggccaaagctatattcgagaagctctccggtaaattcccgaacctgaagaccggcgaccatcggcctggtaaacaacaaacagcaaggaaagtcggtaagaaaagagttagaggaagcggtaagaagctatccccctctaaacagaatagacgcgagctatacgcgatagtacaaaagcagtggcgcactaagaaaagatctaaggtgatcaaccagatactgacaggtaatctaaacaaagaacaatcttatacacatacacccgatcagctagcgcaattctggagtacgctgtttggcagagtcagtccgagagacgatcgaccgattaaccaccggcggtcagttatcccggagctagacaaacccctctctgttgaggaggtcgaagctgcgctcaaaggggccaaagatgctgcaacaggcattgacggagtcccaatctcccacctgaagcacctaggcagtgcagctctaacaatcttgtacaacggattgtatgtgaccgggtcgattcctgacccctggaaaagagcaagaaccatactgatcccaaagtcaaatccaccagcttcacctggggattatagacctatctcgatcagctcgtatttctatagaatctacacgagcgcgatcagcaaaagacttgcttctgccgtcagccttgacgaccgtcagaaaggattcatcaaagaagatggaatacgagacaacttatcattgattgatactctcatcaatgagacgaaagcaggctcgaaatccctattcatgaccttcatggacgtcaagaaagctttcgactccgtgtcgcattacgcaattgccagatctctagaatgggctggcgtccccgatggaatgagaagtgtcatagccgatctataccaggactgcaccactgatatctgcggcagatccgtcaaagtgaccagaggcgtgaagcagggagaccccctaagctccactctgttcaacctggtaatagaaatggtgatgtcaaacgtccccgaacgtttgggaattcaattccagggacacagactgttctatctggcttttgcagacgacctagtcctcctgacgagaggacccacagctaaccagaagctagtatccttagtccatgaacaactagcaagagttggacttgagctacatccgggaaagtgcaagtcaatcgctatcatggctgaccccaagaggaaaaccactttcgtagatcagggatccagtgttctcattggaggcgaacccgtctcttcgctcggtccgcaagaatggtacaaataccttgggattaaactgggatcaggaggcatgccccagggtatttaccgagaccaactagcagaccttctagcgaagacagacagtgcccccctgaaaccccaacaaagattgtatatactcagatcgcatatactaccgaagttcaaccatagactaatgttcgagagagtaacgtgccaaacactagagggtcttgacaaactgatcaggacccacgtcagaaagtggttgaaattacccaaagacacgcctggtccagccttctacgctgataaaggttcaggcggactcggactgataactctcagataccgagttcccctcctaaaacttaggagacacaaaaagatggcggactcacctgatcccgttatcaggttgataccaaacgcggaaccgaccatctccttgttagctagatggaccaagatgtgctccctctatggcaaacagtaccagcacaagtccgaactctctaagataattagagataaatactggacaatgtgcgacgggaaaggcttgaggacagaggtgccaccagatacggctaagaaaacactaagcctgctattcgaggaccggactccactcaaaccaggacaactaattggagctatcggggtccgcctaaatacccttggtacccccgctcgtaacaatcgagctaaaggctacagtcctgaggctaatatttgtgacaaatgtccaggcaacaggcaggccactcttggccacatctcgcaaacttgtccggcgactcacgggaggagagtcaaacgacacgacaagattgtgaacagaatcgcaaaagctctaaaagaacgaggctccgtcaagaacatacttaccgaaccccacctcaggcacgataaactgcccctacggaaacccgacctaatagtacatacggaaaagtcggtcgaaatcattgatgtccaggtcgttgcagaccagggcatctcgaggcacgaagatgaagaccaacaaaagaagatcgtcaaatatgacgtggatggatacaagagagcggcctacaaaatgctagggattgactacgggagcatcccctgcaatgtaagtgcgttcactatcacctggcgaggaaaccttgccccccattcactcaaactggcgagtcgtctccagttttcacccgtgctcaaatatatcgtggctgactccctagttgacacatggggtgcgttcctgatatggggaaagacgtcttagtgacgagaaaagtcgctttatccttacataacagtgtgatagtcatccttatcacaactgtcctggcgaacaaaatggcagagggatagtactcggtccaaccagaaggaagcccacacgatgccaaacttgctgtaacccacgtgagcggaaaacatcctccgagtatagtatgatggaaggatacaggatgtggaccgctctaggcggcggacggtgtagacggcgaccttaccatagctgcgactgctgtgcgatccggaacgggcctttctcacttacctcaagcaccgtgtcggatcgcggggtgggcgcgggattcctgctgggaagttgtctgcacccaagtcgtcagctaactgtcggtacttatacgcacccagagccatgctcttaccaggccacttgacggcgctacaccggtctgtaggagggtatctcagcgacttggacaaaatggatcttgactgcctgagggcgcttatcgagtgacccagagtaagctggtaggaagaatcttgcagttgagagggctagtagggccagcctctgctcgtcaactgtcctaggcgttaacgtgtgcctccctatgaggtaaccgtgaagtattacttgtttccctgtagagaccatataactagctgagaaacgccctgcgggttaatatacagttaccgccgtcctgcatccccgagttgtgaccagcgtacagccatgtaccacggcacttccagcattctctggtctaagaatgtatcagctggcccgccgaaagatagagcgaccccgcctctatcactagagtaagcaggcacgcgaaatatatgcaggacgccttggctcagtagctctggtactgagtatagcatggctgaacgcccctttaagttcggtggcccagagactctccgagacttcccagtcctggagagggtacacctttaccagaactttctgtggtcggttg

SEQ ID NO: 1092 - DNA, 4532 bp, Petromyzon marinus
ctattaatgggatgaagaagggggacacgagtttgtgtgtgcatccagtttccatggtgcatgcaggagtggtggtttaaatggcgagactctacagggcttccatggctacacgggatgcaaggcatcagacattttggcacaggcaatccttttggtctctaccgcaatcatgtcttagacctcagtagcgaccactacaaccacagtggtgactgctgttgagtgaaggacgactgagcgctggataacaactttcttgcgtggcccaacatcgaagcaaccacttcggagctggcacaaggcaagagggcagcccaaggtgtgaatcatctcaacttcactgcaggaagaaatgctgtgcaaggatgagtgtgaacgacaccaacgggattgttgctgaccaggaggtgccaaccaaatttgaatggattgactttgggcctggtttctcctgcgtgtattgcacggaaaaacaagtggctacacgtgtggccgtcgtgtcctggggtttcgcaacacaactccacaagatcgacaactatgaggatgacaatgtacttaaagaacaaagagactgacgccaaaggggatttaaaccgccaaatcgtacattgggtctcactacaatttttttacgtgtatttattttcctaagtgtctgtacttgccattcttcgctgctttttctgcattaattgcatatcgtatgcaaataagcgaattaaccaccaccgtgcaactatatgcagatgttacagctgagccctctatcataccggtgtactaatctggtatggtgttggcatgctatgcttgcgtaacgacctttgctgattggttcagtcggctgatggtgggttcaggcgaaacatttgtatattggtttaatcaaaccgaaacactaaaattttgaacacagttttccattacaccagttgtattgctagaagtgcaaatcgaaggagtcaattttgaccgacgattagctgccgatgtgcggtgaaaaagctgatcacaatagcatacacttgggccgacaaccccgtgtgctataaacgtaagtcgcgaattataaagaaaacaaaccggacggactactcggtgacgaactaacatcgctcatgaatgagcgattaacagacgagctgactacggaatttatcctttcggacatgtttttatgggactacccatgcacagatcagaacaaatgttatccatgcaatcttgttttcctagaccacagaacttggtcatcacatatggcacgggtacatccacatgcaaacaaaacgtataaatgtcgaatttgtaatcgcacagcagatagcatacacaagatagcgtcacactacggaagaacttgcaaaagtttaataggtaaaactaatgctataaccaccacaattgatgaaacactatttagttgtttacattgcagcagaggttttactacgaaaacaggtttaggggtacatactagacgaactcatccgacagaacatgaggctatactacagcaaaacacaccaggaaggaaagttagatggggagaagaagaggtagaaattatggcccataaagaagcccaacagaaggatgaggacataaacatgaatcaactaatacagaactcagttatgccacacagaacgctagaagcgattaaagggaagcggagaaatatcaagtataaggaattggtaaggactttgaaagaaactacctataaggtagaaaatcaatgccttgttaacttagttttaccgacaacatcggaaataacaactacaccttcggaaggagatcagccagcaataagggccgaaaaagaacaatcaccgacagcagctgaggatcttcaggtcataattaacgatctaaagagccagaattttagccacaatcaggcgttactgctactcaattctcatgtagaaaagtttttaaatcgaagtaaaccaattaaaaggaaagatcacgtaaaccaacaggagatagatgagaataggcatcgaagacaatcaaagcaaactaaatacaggagatatcaatatttataccatacgaacaagaaagctctattagacgagattacttcagatagatcggggccaagtatatacccaactgaggaaagcatacggggaacattcgttactttattcgagtcaaactctcctccagataatataccctctaaattaaaaaacgaccaatcctgcatcgatatcgtaaaagcaatcaccttagatgagttgattaagaccctagcaattatgaaggataagtcacctggacaggacaacattactcttagcgatcttaggactttaccaataaaatatttactagatatcttaaatatcatcctttacatacaggatataccacaaatatggaaacagcacagaacaagacttatcccgaaaactaaagaggaattagaaaaaccctcaaattggagacccataaccatctcatcaattgtaattaggctattacataaaattttaagttatcgtctaggacagcaattaaagcttaattacaggcagaaagcattcctcccggtagacggatgtttcgaaaatagtgcattactacacttcatcatacacaacgccaggcaaaagcacgaaaacacgcaaatagtgtcaatagacctcagtaaggcattcgattctgtcagccacgaatcgattattagagccttaaaccgatttaacttatcaaaggaatccataacgtacttgaccaacatctataagtgtaatctaactgatattgtatttggatcgacaataatgcgtaacataaatctaaaaagaggcgtaaagcaaggagatccactttcaccgttactatttaacatgattatggatgaattattagataacttgccgacatatataggagttaatgtaggaaatcagaaagtaaattctatgatgtttgcagacgaccttatcctatttgcagaaacggaatgtggcatgaataaactcttagatataactactaaattcctcgatgacagacacttgaaaataaatataaacaaatgcaattcgttaagatttatcaagtacggcaaacagaagacatttagtgttgcaacgacatcatcgtactttataaataacgaacccattaatccggtatcatatgtaaagggattcaaatatctaggcattgaatttgacccaaggggaaaacgatctataagctgtaacctgctcgcagcaatgttaaacaaactgaccagagcaccgttaaagccagaaaagaaagtatatttaatcaataacaatttaatacctcgtattattcatcaattggtcctcggaaaagttaccaagggtttattgatgtcacttgattctgaaattaggaaaacagtaaagcttctgctcaggttgccacacgatacgcccgacagtttcttttatacatcagtatccaacggaggaatgggtataagaaatttatgcgactcagttgcactatctataataaacagacacaacaaattgataacttcagatgatctagtaataagagcattatcacaacaatcatacactattgcaacgttaaaacaggcccatatcattgcaggctccaaatttccttcgaaatctttaaatcagaacaaatggtcaaataaactatatcaaacaacagatggtcgggggttggtatactgccaatctcaaacagaaaacaattcatggataacagggaatcatagaacaataaaatcgtataattacatagacatggttaaactaaggattaatgcactaccgactaaatcgagatgcaatcgagggacgttagagaccaagcaatgtagatttaaatgtcgaagtattaacaaccaaatttcagaggaaacattggcacatatcttgcaaaagtgtgatcgcagtcattattcaagaatcgcaaggcatgattctttggtgcaatttctggcaacggccgcacaaaaactaaactgggaagtgatcaaagaacccactttaccgagcgatacaaataaggcaaaaccggacttaattttagtaagagactctcatgtcttgatagtagatgtggcagttccgtgggagtctcgatcattggcacatgcatacgattttaaggtgaaaaaatacgctactgacaaaaaaatgcaagcatatttaaaaactatatatccggaaaaagaaattagaacggaggctttaatcatatctgcacgtgggggctggtgcgctttaaataatatggtaacaaaaaaggtgggattgtcaagtgcatgggtaaaattagcattgatcaaggtcatggagggttccgtaaagatatggcgctcttggagcaaaggataatttaaggtaaaatcgtgggattgttttgatggcaatctgcctagtcgcggccttccattttgggtaggcagcagacccatctatataacaaactactttgcctttcataggggtacccgaccctaccaactttcggggaagtaaaagaaa

SEQ ID NO: 1093 - DNA, 5417 bp, Schmidtea mediterranea
  modified_base (4446)..(4446): a, c, t, g, unknown or other
  modified_base (4632)..(4632): a, c, t, g, unknown or other
cagtgctattcgaatgtcaatgtgaagaaattcaactaagctctggttaacggcgggagtaactatgactctcttaaggaattaagaatttacctgccktaktaaaartgaaatcmgttgttcatwgcaagtggtattgtacaccttcccgcggtgctagtcgtttaaaactaagttacaaaccacgaggggcgtcctgacggactgsaaaagcattgagrgtcmtgaagagaggctcttattgtacgaatctcttcaacgatcgaagtctggaccgatatgagaactaatacattagttgacaggtgaaaaatactgttgattacttagttctcagtcatgtggtatattgccagtcaattactacatwaatattagtgtggctctcaaaggaacacgattgrtcggcagtccaatgcgcgactggcgggcttgttgtttgcatttgttaccggctacttgaaaaggttatatatagcagacgcttaaagcgcgactgtaatttacatytcattgcccagtatttgtcttttgtcagatttagcaaaatttcatattttgttaattaccttaactggttaaacgatcccataattgcttgcaattattataaagtaattcaggtaaaaattacatatctggctgatcctgccagtagtcattttacttccgccgcgctataaaacagtttaaaaactgaataggaatcaaaaagaacatggcaagcgactatatgtaactgggcattcaacattccctattacatatggtggtgcctggggtctgttttatataatgggtacccgggaagtggatctgtatcaccagtcatggtgccatatctttkgataaagatacagtttaaaactgcgatgatactaatagagatcctcttagaccttcgtaaagaagtggggattgatgacattagcattggaagaattaaatctccaaggaaatggagtaacttcaatgaagtcccacaaccccgttgaagggctgggttcgagtatcgagagaaaactctaaattctcttcggttmtgtccaacggaggggacattactgtaaaatatcctctaaaaacaactatgaaaaaagtcttaaataatgaaaccgaaaaattaccgggaagtaatctaactttcatgtgcgggttctgtgatcgggaattcgacacggcwaggggcagaggagtgcacgagagtagaggtcatttagttgagcgggatgcggcggttcagagcagagtgaaagccgtggtgagtaaaaagtattattatagtaacgaagaggatgtggcattagcgaaaatgcagttasagcatgcagatctggccaaaagcgaacwattagaagccatgtatcttgcattgggaaagggaagaactcgtgaagccatagagcaacacataaggaaatcgttacgttataagggggtccttgaagaacagcgaaagctccttgagacagcaaggggaaatgttcggcaaaataacgtgggtgtgccagctagcaatgccactaaaaatctgcaaagattcttagaatcgttacccttgggaacgaataggcgcgaggaacgattggataggattatccgatctaactcgatcgaaagccaaagacttgaattgatccactattgtaacgatatgtgtcaagactttgtgcaactagactgtcaaargaaccccatcaatgctataaggcgcagaaatccgaaaagactatcgaaaaagcagttgaagagagctaaatttagcgctcttcaacggctttggataagggatcggaaagctgctgcacagttagtgttgaaggataagcttgatagtttgctcagcaataaagaggattccaaggatttgggatcgtattggcaacaggtcttcgaacgtgagtccgaattagaccgcagacccataccacaagtggtggaaaacgaagagttaaattccccggtattagagaaggaagtagagtgggctgtcaaaaacattaagaagtccactgccgcaggaccagacgggttaacggcacttgccttgaagaaaataccgtattccgagctagtcaaactatttaatataatactgttggtgggattcctacctgatgtattaaaaaatagtagaactatcctaatacccgaagtggataatccccaagggggyggtgattatagaccgatttcgatcaattcagtgctcactagaacactaaataagatcctagcgaaacgagtctcggaaggtgattttggtatcaatggtcaaaaaggattcaaaagtgtagatggttgtctagagaatctagcaacagttgaatcaattttggccgatgctagaatgaagaaaaataagcttgcggtagtattcttggatatgagtaaagcttttgattctgtaaaccacgagagtattgttagagctggagaaatcaaaggttatcccaaactattaatgacgtatgtgaaggagtgttataacgacgctactacgaacgtcgcaggtgtaacagccaagtttaaccggggagttaaacaaggtgatcctctttcgccggcgttatttaataacgtaatagaccttgcaattgagcgagtttccggtactggaattggatataatatgggcggtaagaagtattctgtggtcgcgtatgctgacgatcttgttctattcggtgagtcgagagaggggttgcaaatagccctgacggcgctactggaggaattaaagctaaacggtctgacacccaatccagcgaaaagtgcttcgttgacatttgagagatcagggccacattggttcgcaagtaccgataccgttacagcactaggagatcaaataccggccatgggtaacatcgaaacctataaatacttaggaatcaagtttaattcgtgcggagtggttaaagggagtctacccgggatatacaccaagaaattggagttaatctctaaggctcctttgaagccgcaacagcggttagctatgctaaccgatttcttgattcctggagtattacaccaagccgtgtttggacagacaaatgcaggggacctgcgcagtctcgataaacggacgagaagagcggtgagatcttggtgtcaccttccctctgatacgtcaacggcattcatccatgctaaagctaaggatggaggaatgggaattccatctataagagccgaagtccaatttggaaaattggatagatttggaaagttacccaatgtcaaagatgaacgatckaaagttttggccgataatgctcacattaaaaagaagatgttagagaaattgggagtggggatcccaatcaaaggagtgcgttgtaagaacaaactcgagttctacaacaagatgcgtgaagagttgattaagtcgaatgatggcattggcttaaaagaggcatctttggttccctctgcgaacacttggttaaaactgagtgacctacatatgagcggtcgcacatttgtaggatgtcttaaaacacggggaaaccttatggctaccgtaacaagaactagcagaggaggtcagaacccgggtatagagttgaactgtaaaaagggatgccaatatcagggaagtctgaaccatatagtccaaaagtgcccagtagtgaaagggttgaggataaaacgacatgatgaagtcgttaagtatgtggaagagatcacgaaaaaggctggatggtctgcaacaatggaaccaataattccgttcgaggggtcacaccgaaaaccggatttagttctggtccggggcgatctcgggaaagttgtggatattcaaatagtttctgatcactgcggtctggatgaaaaaaatagttgtaagatcggtaagtatgataatgacatcatacgaaattatgtaagggggctaggaccatcgagagtggaggtagcggcgataacccttaattggcgaggcgtgtggagtagagactcattcaatctcattaagagattaggaatgacagaaatggatgcgaaaatcatttctatgagagtgctggcgagcactgcgaagatgtttaagacgtgtaaaaaagtgttagagcccgtttgcagaaccaagaccgctgattgtgatggttacggaccggaggaaacctccgcccgaccatgtcatgagcttaacttgaargagagttcggggacgtaaggccacgcgcgtcgtccttgtttgatcactagtggatcaaccttcgactccccggaactgtgggagtggcggaagaaaggccagaggatgtcctgaaaccatatatttatttatagaagttttacttcatcctatttacgtatttcagtatgaaaatgagtaaagttctcgactcgatgagttgggggcaaccattgggggtcctgaagagaggctctcactgtaaaaaatctcttcgtgtctgtttattcctaggcacntgctgcattatgaagcggwgaaagtaaagttagagctgagagataggtacttgctgcattatgaagcggagaaaggcctcgaataaatagggtgttagagttattgatggagagtatactagtaagcttaagctgcgcctcgcgcggtgcccaaaaatatacttaatgagagcaataactcaaggngagtttaattcatatgcgcatgcggcaccaaggtgctgaatggcatcgattaaacctctcctgttgtagaagcaggtcataaatggaggrgggcaaccactgaaacttatgagccagaagaagcttaactacawaagttttaggcaattactgaacggagttaactgttagttaacactaccatgtagttgtttataaagcaaatatcaggtttcagtctatatactaaaagtattttttgataccgtggtatataggcaactagttaggaaatagtaagggatgacgcattgtctctctttatggtactgaggaaacttatcgactcgcgagggatgaaacccgtaaaccgatcgatytagcctataagtaccagcgacagttaaaccatcttacgcgaggggtaaaacctgaggaccgattatggtataacttctcaagattagcacaaaatgcgagtgcaacttgaggaggaggatttgagtgttaattcataatgtactaatctaattaaactgtgacgggaattgcagcttcggctgtaattactttgaggcctatcacggattgtaaggaacatattgacaccgtaagtctaacgtgttcccgatttccaaccaggtcatatgaagggctgcccttgataaggcggatttgacccaattcttcatatgagaggcttattccagccttcccgtagtaccgtgaggttttcccgcctcgaacggaacaatgttgcagggtaattaagtacatcgggctatatmgcgatatttaacgtttta

SEQ ID NO: 1094 - DNA, 5586 bp, Strongylocentrotus purpuratus
tctcgcgacgcgttcttctgcctgatgaagtcacgtcaggtaatagacttagaaggttgatgagcgttcctctcctggaccgggggtgaggatgtgttctactgaatcatcgttccggttgtgaggtccgctgcaaataggccttggggtggtctacctccgggtcgctactccttttgagctagtcgatccaggtgagagtcggggaagcccacttaggtgggccagctaagcagatcacccccccagcacgacagtgcgctgtaatatagcctgttgagagtgcacccatttatactgttataaaagtataaatggttcttagctaacctatccaatgatttttattgttatgtataatactgaccactttagtctagtgtcatgtaaggatccgagacaatagcctatgtctctagtctagcaataacacaagagggataatccacctccctactccagccaccacctttacctttcttatcttccatatagatgccaaccagacgggtcgatgggcagtgagaaacaagaatggggataatttggaatttgacattctttcctaaagcagacctgaagggttaagagtcacaagcggagtccggactgtctttataaacagacaatattttcttattttaccacctatatggggatatttcccaactcgtaatatagggcccactgtcaagtggctggtataagttaccctgtgggtaacaaataaattcaaacaaagaatggaaaactcctttgcgtgggagggtaccagttctgctgaaggcagaacaacagttgaggattcaccctcaagcagtgacgattttgttagcaatgtcggattcaaagtagctaaggcggatcccactgtgtgggaggaagccaatatgtcagaagacaatacaataattgaggacccaccatcgagtagcgacgactttgctaacaatgtcggcttcaaagtaactagggcagatcccactgcgtgggaggaagccagtacatctacagagactgaggatttaccctcgagcagtaattttattgacaatgtcgagacccaaatagatatggcgggccccactgcgtgggaggacgccgatagcaatgaagataacatagatgagggcacacccaataatattaataataatttagcaatagtcagagggagggcggatgcctatgcatgctcgtgttgcgaacggaacttcatttctctcaaggcaatcggtactcacctcaaggaaacccataacaaaaaggttgtctttgaatgtgccaaatgtcaacacaccttcgttaaagcacacggactagcgtgccacgtccccaaatgcaaagaggacgccgacacacctatgcttaatagactgctccacggctgtggagagtgcggtcttgcattcaatacgagaagagggctgtctcaacacgagcgccataggcacccgtcggcgtgtctaagtactaggagaaggtcacggctagatggtatagctaggaaaaaatcattgaggaataggagggatatttggacgaatgatgagatccgtctactcaaacaactcatgatacagtacgagcatgctaaaaagataaacattaagatagcggaacatttcaaccataagaatgcaaaacaagtcatgcataaacgtagatccttaagggaaaaggacatggccttaggtgctccacatgatgcacctccgccattggcagaagaaccgataatagaagtagttgagggtgcgagagaagagttagaacaggctcctgtagatgtaatccttccagatcttgaagcactcacggttaatgatgggagagggggtggcagccccgtgttgaccgagggaggggagagtacaagggatatggaggagaacggggggaccgacacacggtctccctctcccagagaggagagagcggggtcgaccccctgactccggggggagtggtagaagattatgatgactcgtacttagaagactacttccctgggtgggatgaggatgagcacatgcatattattgggaggctcgacctaagtgacgagtcggaacaaggggaggctgctgtcagtccaagactaggctccttcggagacctattagaagaagttaatgcaatggaaggcaaggataacctgtctgaggcactggccgaaaccctgggccttgtgttacacgaaggtcatagagtagaatacattaaagagaaaatgaacataaatgttaaacaaatggcaacagaaatattagcccacggggcaaataagggaaaccccaaacggagaaaggaggcggtcgccgccaagcggaatcccggtacgagattagatcgagcccagagggacaaccaagcgaaggccaaggccaaggagaaaaagagaatcttctccgaaacacagacccaatataagaagaatccccacagactcgtggaaaaacttcttgatgggaagggtgacgagcggtgctctgtcagccttgaagtgatccaaaggacctacatgaacaggttctcaagagaaagcaaagaggttgacataggagcctatgttgaccccgagactgtggaggataaccaagggatagtggaccccatcagcaaggctgaaatagaaagggccatctctaccacgaaaaagggatccgcacctggaccggacggggtcacctatgatgccctaaaggcgtatggaaactgtcaattatacttattaataatgtacaacacatggctggccatggggaaggtcccatcagaggcaaaaacctacaggtcaattctaatcccaaaaggtcaaggggaccccatggacatcaacaattttcgtccattaacactcgccaatgtaatcagcagattatattccaaaatcttgaccaggaggctggacggggcggtaagtgtctgtccgaggcaaagaggcttcactcacaaagctagtattgaagacaatacactcatcctacgggaactcatcatgaagagtaagagaaataaagaatgccttgcagtggtacttcttgacttagccaaggctttcgacaccgtttcccacgatctcatcatcaaggccctgaggaggcatcgggtgcatgaacatctcattagcgtcataatggacctgtacgaagggggaactacatctttcacgacagatgagggcaccacctgccccatcgcgatccggagcgaagttaagcaaggagactctttgtcgccggtgttattcaacttggctctcgacccgctactagctacactcgagcaaagagggaaaggtgttgagatcgggggacacacgttcgtcagcctggcctatgcggatgacacggcactcgtctcgtccagccacctggacatgaccgcaaacctagacataactgtagaatacctcaatgcaacgggactgagtctcaatgtgaggaaatgtcaaggcttcttactcacccccatcaataagtccttcttagtcaatgaagccgagagctgggtagtggaacgggaagctatcccgtgggttgaacctggggacacagctaaatatctgggggtacaagtgggtccgtggtcacgtccgtggccatccattcaaccagtaattaaacgcctcacagcctactgtgagagcatcgacaaagcggcgttaaagccaagacagagaatacacattctaacgacctatattgcccctaggattgcctttgagattgcagaggggggatacagtacactcgtataagggaggtagacatgacaatcagaaactacgtcaggaaatggctattcttgcccgcctgcctttcaaactccttcctttacacaaggagaggagagggtggtcttgggctggtaagcttttacgactacgtaccgactgaacgtatgaggaagctagttagggtgtgtgattctgaagatccggttatagcaggggcagcagcctcgctagggttaagggagagagctgcgaagataagcgctcagacagggttgccagttccagttaaacccaaaggggcacacaatgcatggagaaaagtccagaagaaaaagtggaaagctcaacccacccaggggaagggagttagttgttaccaacacaggttgggcaacaaatggttaggtgcccccagcttcctcactgaaaatgactacatttgggccattaaactgaggacaaacctcgtccctactagggaagctatggggagaggtatcatagggaggaatcaagtggagtgcagacactgccatacaacaatagaaacaatgggacacatttctggatactgccagatggtcctggatattcgtttgattagacacaaccgtatatgcaaagccctgatcaaggctgctacggctacaggactcagagttacggaagaaccacgaatagtgggtacggatgggaaaaactatttgccagatcttattttcagtgcgggagctggggagccatgttatgtagttgatccaacagtggtgtgggatgatgatcccaagaacctgagggaggcctggaggggcaaggtgaggaaatacacaccaatcattccggcggttgaagcgatgcttcacccatcatcagttcaaatatttggatttgtatgtggcgcaaggggaacatggtgcccaatgaatgatgacatagccaagattgtcggtttaaagaactcaggaattagcaggacactacaaatagtcctttgcgacaccataagaatggtcaaggccttcatggccagataaaccttgcctccccgggcccccctcagtgactaagacaactttcaccgtaataatcatatatttgtataccatgtattaatctaggtaacaattgaaagtaacattgaaccgtattcatactttaatgagtacaatagtgaagggaactgtatattacatacctcgagatagaggtttttgtaccttaagggttcgtgagaatccatactgcataaaggggttaacttgtaactcaaccccagggagacaagccgacaaattcggcattactatgtgagggtcataagtgttaaaggacccattgtatataacttgtaaatgtacagagaattcgagttgagttcgaagaataaacaaacaaaaaagaaaacaaagagaattcgttcgtccatagaagcggaaaaagcgcaaaaaggcgtcctaacctcacggtctaacccagaaacatttaaggggggaaggagctcattactccaatccaaaaccacgttccctagcccaaaagcgcgcttcaatgagggagccgatattggaggacagagttcatcaaaagccacctgtaagtaggcccatttctgccaaggacatgcgcaaaaggaagcagattatcaaaccagtcaaacaagcacaaacattggggggatgggataaccccggaaagagagggatctttagatagtggatggaaggggtgggacgttgaatccaaccatgccgtttttatgttcccgataaagaaggataaggtcactccagcctgacacacaaagtggggtaaaagaactccgctcgtacggactccaaatagaa

SEQ ID NO: 1095 - DNA, 7867 bp, Salmo salar
aatctttaaccccggactcttggggttcttacgactctgtatgaggaacagtcgaagagagggcgctaccaatccaagtatatgtcccaagagggctgggacagggtggaagagtgcacctcgcgatctggggcagggaaggaatggagagaagtcgaagaaggcttgtagagaaggggctctcctagatcctaacctgtatgacgcccgtaaaacggtgaccccagtagcgaataaaggaggcaggtgacaatagagggcagggccgacttcccaggtttacattgttgtacttgtcaacataaagaggtgtctcaatagtttgaatcaacaagggagaggaataccgacctgctcccttggggcgggggtactggtcttagcccggttccccgcaagtttcctttgcctgggatgtgcctgactggctccatcccctttccccattaggcacggctagatgacgcaccgatgggcgggtgtgtaggtcgctaccgaaggggactgggggtgtccggtgaaccaggacttcccaaaatggtctcacatttttaagcggcttgagtatcgcccagtatcctcgcgcggcactgggaacccagtcaaccgctctgtgccccggcgcaggcgggggtttaatgtctccccggcttcaccggcgcttcggcgacgacgcagaggagcacccggaggcccccatgaacttaaaccaacctatcttgaaatatggcctctcgttcgggtgaagggcaggtgggaagagagggctgcctcacgataaacacctagtcaatagccagtcgggaaaaatgtggaatgttaggacagggaggtaagggaggcggctttttcgtaaggctccttcaacccctacctgtagtccacctattgcaggtgttgacaacatgcaagatgacctgcctcgttacgggtcgcgtatcattgctacaggtcgtgtgccgcttctaagaggatagtaaggagaggttatagggaggtcctgttagggcttcctcaacccctctctatgcgattccttacaggagtggatcgagaagtcccggacgtaatacaccctggaggtaagggagtggccttctagtagggctgcttcaacccctctgatgggagtgtaccgggaacctcgacttgtaagcacaggttagtatgggagcagaagggggagccgtaatgggcttctctttcacctgcttacataatacctgtggtgcatgtatctaggtcttggcgggagagtactgagagacaaggttgagaccccaagattgggtctccctagcctctatagctgcgactcttagcggggatatggagtaacatgtaccaagggagtgaataataaaggaattgacggggtacaagtgactgttggcccgaatcctagccacttgatgaccagggatatattacagactgagagcgaatctagagacgtgagaataaagtgagaattggttgagcgaatacagaggaagatgagcggaaagagaattgttgagatgagcggttgcgatgagaaaatctgccaaaataagcattgcttgaagcgcagatgggcgtggatttccggcccaaagggggagacatctcctcctcgcaagagaggaacttgcgaaaacgtatccttccaggataaatctcatgcctcggacccagatcctctcaaagccccggaagcgagagaggacgcgggttcggtggcgcctcagtgggttggcgaaataaagacacctagcctaacatcgcgggatggggttagtgaagtcgtgctgccaccacagccagttcatgcagagggagtatccccagccagcgactcaaaggacaaggctacgaagatcaccctgctgatatcactccccgtctgtgatttgagatgcggacgatgtgaaagaccattagagaccgttgggaaggcggtgagacactttgctgtggctcatccgacggtgtcggtggtttttaagtgtcaaaagtgtgagaagagcagcaagaatagccactccatctcctgtcatatccctaaatgtaagggaatgacagagacccggacggatgtggaaggtgatcacggctgtgatcattgccaggagaagtttacaacggctatggggctgactcaacacaagagacacagacacatcgtccagtattgtaaggagaaggagggggagatgacagcaagaaggaagggtgaagtcgaagcagtcaaatggagcgaatgggaagaaagtgaggtggcaaggttgagcgatggactggctgggctaaaaatgatcaacaggcgaatcgcagatagcctggggactggaaaaactgcggaacaggtgaggcagaaaagacgtagaatgagacctgagaaggtacggtgtgacaaacctaaggaggcaaaagataagagcaatcttatcaaaatgctgtccataccgagtgcaacaccaacaccccaaactgggctcaaaggattcctccttggagaactaaatggggttgctaccaaaggtgaagtacagattgggggagttacgttgtccctaaggggggtagagcaagactcagccttgctcaatacgtcggcccttgaactgcaacgattgttgggagggagagcggggagcgcgaatccgttaagcttacagagagaacgtgagaccacattgccaagtgaaagaaggaaaacgaaacaaggagagtaccggagggtacaaaagatgtttcgaagcaatgaaaagaaaattgctaaatacattctagatggcaatggagatggagaagcggcctccccgccactcgagatcgctttggcgttcaaaagtaggtgggaggaagtggaaacatttcatgggcttggccagttctactcgaggggggaagcggatggtgtggtcttccggtcacttatctcaatgagcgaagtatgtgaaaacctgggggcaattaaaaacaacacagcagctgggccagatgggataacaaaaccggcattgcttgaatgggatcccactggtgcgaaactggccgctatcttttccatatggttgacatcgggcaccctgcctgggccttttaagaagtgcagaacaaccttaatacccaagaccgatgacccgattttactcacccaggtggctgggtggaggcctctcactatcgggtcggtggttttgaggctatactctcgcatcctgacacacaggctggagcgggcgtgtcccattaacccgcgccagagaggattcatttcctcacctgggtgttcggaaaacttgatgatcttgggaggtctaatcaagagaagttgggcgaagggcgagaggctggcggtagtgttggttgactttgcgcgtgcgtttgactctgtgagccactcgcacatcttggagatactcagacagagagggcttgatgaacatatcatcggaatcgtaggtgactcgtacaccgatgtaacgaccacaattacagtcagtggggagcagtcccctcccattgacatgagggtaggggttaagcagggagacccgatgtctccgctactgtttaatctagccctggacccaatgatcgacacccttgaacgctacggcttggggtacaggatgggcgagcagcagatcacggccctagcttttgctgacgatctggttctggtgagcgactcgtgggagggcatggcgtgcaatatccgtattctggaagaattttgtcgactgactgggctgaggattcagcctaggaagtgtcatggtttcctcatacagaagattcagagggcgagatcggtaaacctctgtaagccctggatagtgtgtggtgaagaactacatatggtcgggccggaagagtcggtttcctacctgggtatgaaggtgagcccatggcatggcattatggagccagatcctgtcgaacgactctgtaactggatcagttcgattgggcggtcaccgctgaagccttctcagaaggtgaggatgttgaatgtttatgctgccccgaggatgacttatcaggcggatcatggcgggctggggccaattgtcctgaatgtactcgatgggatgatcaggaaagcagtgaaggtgtggctacaccttccgctgtgtacctgtgatgggctactttactctagatgccaggacggtggactgggcatagtaaaattggcttgtcaaatcccttctatccaagctagaagggtctaccgcctgtggcattctaaggaagccataacgcgggtagtcacccgaaggacggtcgaagcggaagagtaccgtgggatgtggctgagagccggtgggagtgaggcaggtttgcctcccctggaagatagggaagaaggtgctgtacagtgtacagacactgccggttcggtgaagccgaaaaacccagtcattcccgattggaggcgagctgagttcctcaagtggcaaaacctgacagcgcaaggggttggagtgcaggtctttggcggtgacaaaaacagcaatcactggatggcgaatccggaaacgttgggatcgaaagagcgccactatattgcaggtctacagttgagggccaatgtatatccaactcgcgaggcactgtccaggggcaggccggacttacctaaagtctgccggcaatgcctagcaggaactgagtcttgcgcgcatattctcgggcagtgtcctgcagtgaaggatagccgcatcaggcggcatcataaactgtgtgacctgctagcaagtgaagccgaaagcgccggatggaccgtcatcagagaaatgtgttgcagaactcgtgccggagctttgcggcgtccagacctggtgtttgtgaaaaccggttttgctttggtggtggatgttactgtgcggtacgagatggcctatgatacgctcatgggtgcggctgccgagaaagttgctcggtacaccccaattactccatatgttgcgatgaccctgaaggcaaggagagtcaaggtgtttggctttccactgggagcccgaggcaaatggccgggaagcaacgaccggctgctgaaggctatgggtgttggtggcggcaggaggaaacagctggccaagttgtttagcaggagggcgctcctgtactccttagatgtccttagggacttctaccgggcggagggagaaacgggggacttggatgatgagagcgtggatgatcatctatagatccgtttgttatgattggagggagcctgccgagtggtatgagcgctccaactattgaacccatatgattcccgaggcctggccagacgcctagatgcctgccacaattgaacgcagccctagcttgctaggagatccataggaactggcctatggggcgtcatgacggttgaagttcctccatagcgtgcttgggaggggacgacaatgacgagtcatgacgtaccgagagaaccccaacccaggttgggggagagagccagcaagagcggagatgcttggtataccaagctagcagagagagggttgaagaggatgactactgggctcagagtcatctcaccctaaaaggcggtggggcatcggttgaacacctacccataccgggatgggaggtggtaggccgaaaaagaacaggaagatggtggagtaagttgagagcggttgctcgggaagttatgttgtgataactccattaaggccggtgggcatggtgcggataatggaaactataaaaacaataaaaagaaagaccaaaaaaatgttctgttatgatgccttacacatgtctgggagaccccataagggtctccccttatacttcactgggaaaccccataagggtatccccctatatttactgggagaccccataagggtctccccctatagatgtagagcgtaaggggtctccaaagtaccggccgatatggccttatggcaaactctggtggtagggacaaggaggtaagggcagtgccaacccctacttgatcgggaccatccagggaatgccatcctcccgcgaaggtgatgtggtgaggtaaggggggagcccgtcttcgagtttccccaacccctacccacaggtgagaggaggagaagaggaatctgtccccaacgggaggagggtgaggtgtaagggggagaccttctagtagggtcttctcagtcgcctgacgtcctgactgtggggtggatcagtaccctacaggtgagaccggtgaggtaagggtgtggccctcttgagggctgcgccaacccctactcgaggtaacctgagggagtggtggaatggcggcatgttagtgctgggacttgattgcgagggtttaatgagagtggcctgctgagagcaacacttgtggtgcttaaagcggggcggcccatgaccaccgtgagataggacactgcacagtgcagccatgaggttcctggaggatgatgcgatgaggtgggggcctcatcagcccctcctggcagggcgtcggccagggaaactaaatgtctctagcatgtcagtgcagtgaggtaaggggagagcactctagtagggctcttccaacccctacctgtaggtcacctggtccaggtgtcgatgatgtgaaaacaagagctactttggtaccggtctgttgcaaaaagggttctgcagaggacgacggctatccctatcgggagggaatagtcggtcccaggtagtggaaaatggggctttccactgagcatgaaaatgtggtagaggttgcgtccaacccaatgatttgcagcagagctcttggacacgaagtctgtatagtcccatgcaggcagccaaccagagaatggtggcaagaccccagctccgtatgggaggggagggccaagatatacggaacggctgctaaagcgttctgccggtgtcagtctaatcacagacagctgtgacgaaacaaagtatgggttccgacatgcttggtcagctcttagccgcaaggcttaaatcgaacgcagcccgccgagagtgaacattaaacggggatggaatgtgtctagcggttacgtactaccagggctcaggttcgcctgagccgaggctctacacgtcatggtgggagttctccccacgctcgtgagggcatgtagtgggatggcatgtggcggaccatcagctggcactaccaggcctcgggcttgcccgagtgcgggacctcacacattgtaggtgtgcttgtcccccctacgttcgaagacttgaggcggagaatactcataggccccacggcaaagggacacaacacggaggcttgtgtccgacgagccgtggactcctatagacagcccgggatatcactgggcacgctcatactgaagaaattcgatgaaccgggcctaccggagcaaatgcactctaatcgcctttgtgggcgactgtggccccctcatgcgagtgaggaatatcataaactgcaatggttcaaaaagtgattcctatggctcgtcggggagggctgactggggcaagcaaatgattgaaaggggaagaacctttttcaactgtttcttgccaagcccggttgatggtggcgctagtaattgcgacgggaaaatgcggtttaagtctccgaagtagtgcgtagcaccggatgtcgaccgggtgtaaaagcccttcgtaaagtccctggggaggtcagtcctggggctactgatgcgcagtatgtaattcgcagaatagggccatcgataccgcctgcgtgactcgactgggtttccacttgaggatatccgaccgtagcgtgcaccctcttgtagttgcgccggaaacggctgtgttccctcacgtatgtgaggaaactcaacaatgtgagtgggtaaacggcgggacgaactatggctctcgt

SEQ ID NO: 1096 - DNA, 4155 bp, Tribolium castaneum
agtcatagagccagaacctcctcgtggtcccgctgggcacagggattaatttttctgtggcaaatttgactggcttcagagagcgtttttcgaagtggwctgtgtgactgcgttccccccttagttgctatwtccgctkmgattaacatctcacctcgacgtwtaagatcattatgtcgaggcgcccggggaagtctaatgagcccccggttcgtagtagggctatgggtttaaccactttatctggcaccaagacatcaaattctggtgcccaggggccctctaccagtgcccccatgcagaacatggctgggggttttgtttgtgactgcggccggagctatgccttgaagacatctctggcccgacacaagaaggagtgcggaaagaacaatgcggagtgtcgatggtgcgggacaaggtttaacaccttggctggcactcgtcagcatgagcgaaaggctcactttgtccagtatcagtctgatctggcaaaggcgctcccccaacctgagtcggagcttatggagaaaatcgccattgtggaggccaggtccaktaacggcatcttctataaggagatgatggcctccacgggtctgacccaccaacaggtcagatcaaggagagagaaacccgaatataagggcttcctggagcgagcacgcaggagcctggcccagaccaatatcagggctggctccatctcaccagcgagtacgawcgcaggctctttggagtctgcgtctccgaaagcggggtgtagtagcagtgcctcgcccggaccgaccaccaggtccagggcacctaccaagggtgtgccccwacgaagctctaattcggcgagaattgtggtggaggcccaagtccatacccgggcgccacccaataccggggaaacggaagtggctcttcgtgagtcacgccgaaccgtgccccggctcgggcmtaatccatctaggccctgtggtatctctcctttgatggcgattgccatagatgaagactctgtgttgggcgggctacgagtgcaggccgggccaagtcccaccgcggtgcactccgtcgaagctttccccggaacgtcctcgatgaccccgatggagaccgatcgggtacataataagtccggtatagaccccattctcgaacataatgggacacggcaggttcgaagggaggagtcttccacacgggaagaccccgtcgagcaatggtctcccaactatcctaaaacgcctgtcactatgcccaacattacaactactgctgatgctwcgtkcacctcgtacaaccgaacacctcagacactccctggaaaccggaggcgacgcagtcgcagtctaccaccagtgcaacggaaatccgcttccgacgawctcgagtccgttgattcgctggggccctgggcggtcttcttgcaagatcaagtagacgccgggtcactaagcggcaacgactcgctggcggatctggtgagggtggctctcactaagtccgatcgcggtgtccttaatgatgccgtgaatcggtatctggcccaaagggcggagagcttgaggatacgtaagcgaggcagtaagggcaaaagaaagagtaagactggtcgccactatggccaaacaacatctggcagtggtcaaagagctgcgctctttaaaaagcaccaggacctctttctgaaaaacaggcgaggattggcggagactatcttgtcggggaaggaggattttggtcctagacctgaacctcccgtaacaagtgtggaagagttctacggcggcattttcgagtcgccttctcctcccgataacgaacccttcgaagtccgtgctactggcgtcgaagacccccccccacttacatcaccatggacgaaataaaggcggcaagagccggttggcagatttcagcgcctggatctgaccaaataccggtcgcggccgtcaaaactatgtccgagctggaactggcgatactgttcaatattatattgttcagaaacgtccagccttcagcctggggggtacttcgtacgacgctggttcccaaagatggggatcttagaaatccggccaactggcggcccattacwatcagttctgccctgcagcgtcttttgcatagagtattggcggcccgtctttcgaagttggtctcgttgagttcgtctcagcggggctttaccgagattgacggtactctagcgaatgcgctgatactgcatgaatatttgcagtatcgcaggcagactggccgcacctaccasgtcgtgtctctggacgtcagaaaggcgtttgacacggtttcccactgctctgttagtagagccctgggtcgttttggtatcccctctgttatcagggaatacatcctggccacatttggcgcacagacgaccataaaatgtgggagcgttacgacaagaccgataaggatgctccgtggagtgagacagggtgaccctcttagcccggtcctattcaatcttgtgatggatgagcttctggaaaaggtcaatgagaaatacgagggcggctcactgcaaagcggcgaacgctgtgccatcatggcgtttgctgacgacctcatcctgattgctgaccgagatcaggatgtacccgcaatgttcgatgatgtttcgacatttctcgagcggcgcgggatgtctgtcaaccctgccaagtgcagagcgttgattgcgggcgcggtgagcgggagaagtgttgtgaggacaggcagctcttataagatccataacacgccgattccaaatgtcgacgccctagatgcatttaagtatctggggctagaatttggccacaaaggcgtagagcgccccacaatccacaacctctccgtctggcttaacaacctcagacgagcccctctcaaaccggaccaaaaatgcttattcatccggcaatatgtcatccctcgattgctctacggcatgcaaaatcctcaagttacctctagggtacttcgagaagctgaccgtctgataaggagacacttaaagacatactaccatcttaatgtccatactccagattctcttattcacgcgagtgtgagtgacggaggtctgggtataatggaattgcgtaaagcaattccaagaattttcctaggacggctagttaagcttctcaacaaaaacaaagattcggtcttaagttcggtcctgcagtctaaccgtgtgagaacactaatgggcaaattatcaaccatggcgggtgaagtaccggagtcgacgttttggagaaatcagattgcctcgggtcccctttcgaagggtctcgaacaggcggccgaggactccgcaagtcgactctggatcagcgagaaaccttccggttggtcgggtagagatcatgtccgtgcagtccaacttcgcacgggcaacctcccgaccaaagccattccatcggtgccggttggtcagagacgctgcagacacggatgtgcctgcgatgaatcgatatcgcatgtgctgcagatgtgccccctgacgcacgctgatcggattcgcaggcacgatgaagtggttaagaaagtagcccgccattgcacctcacgcggttggacggtggaagtcgagccacacattcgctctaggtgtggtaggctttttaagcctgacctggcagtccatcagccaggcggcgccattgtgatagcggatgtccaggtatcatgggattccgaaagcttgacggtaccttacgaacgcaagcgagctaagtacgacgtgccccaattccatcaggcggcacaacatgcatggccgggtaaggcacttacgtttgcccctgtaatagtgggcgcccggggcatatggccccggataaacaacgaccgctctgcggcgttgcagattcctccggtcgtgcgacgagcttgcgtaaattcggttgtcaagtgggggtcgtcgatccatgctacctttatgaggtcagtatgggcaaatcgactcaacccccgacccttaagggcttgaaaagagtggcagttgtggagacttccttcggacgtcgggtcggattttcggacgccagggtacctccaccgctgggttcacaaactaggcgaacatctgccgataccctctttaggtcataggaccacatgtctctgcacgagattaaccca

SEQ ID NO: 1097 - DNA, 4432 bp, Tinamus guttatus
  modified_base (423)..(423): a, c, t, g, unknown or other
  modified_base (680)..(680): a, c, t, g, unknown or other
  modified_base (704)..(704): a, c, t, g, unknown or other
  modified_base (725)..(725): a, c, t, g, unknown or other
  modified_base (1355)..(1355): a, c, t, g, unknown or other
  modified_base (1577)..(1577): a, c, t, g, unknown or other
  modified_base (1952)..(1952): a, c, t, g, unknown or other
  modified_base (2021)..(2021): a, c, t, g, unknown or other
  modified_base (2852)..(2852): a, c, t, g, unknown or other
  modified_base (3614)..(3614): a, c, t, g, unknown or other
  modified_base (4134)..(4134): a, c, t, g, unknown or other
ctggggaccgtggttacaacccgggcttagctgcagagacagtacctccccgtggttcccgccggaccccgtaacatcgggtgactgaatctgtctctgccccgggagtagttcctccttgccctattgaccagcggtcgccggctgctcaatagtattctaggcgtgaaatatagcgatagtcctagtggttgtcttactgggccatagccccttgcttcaggggtcattcgcgaagtctctcaggagaactgggggtggtgttcttctgggtatagctaaaccccctagactgtgtccgatccatggggtcctggatcgtgaatttcgtttcggtggcgactcagacgggagaattccctgtggatacggccaggagggcacctgtgccggtaacatcataccctgagtcggaatgccacntaccgttgcccctgacattttgtaactcggatgtgactatttggggaggggttcgccctgaaccggtggactgcttgggwgatcttccrgaggygtatgatgcactcccaggggtggctgggcctcgggaaycggtgggtgggagcccgccgggrgaaggggtcaggtcgccagggattgcgtcrccctctggtactgcggtccaacatgattttgggagtcccatcctcgtaccgggagccgaagccgccgaggtntctaccccggtagtgaaggttccncaagaccatccagcatgtccntgctgtggtacgagggtggtgaaagtaacggcgttgtcagaacatcttaggagggcccacggtcggaaacgggtcctatttcagtgctcccgatgcgggaggatgaatgagaaacatcatagcatcgcgtgccatttcccgaagtgccgggggcccccagttgaggagggtcccctgggtgcacccgagtggtgctgtgaggagtgcgggcagaaatttaacaccaaaagcggcctgtctcagcacaaaagatctgtgcacccacttacgaggaatgtggaacggatagaggcagctcgtccgaaaggaaaagggaagcgtggtgcccacaaaggctgttggaccgaggcggaggtggcccagctgattgaactggaggggagattcaagaaccagcgatttatcaacaagctgatcgcggagcatttgccatcgaaatcggcgaagcagatcagcgataagagaaggcagctggcggcagcgaccaagacatcgtcgcccgagaagagggtaacgtcatcaacgagtggggagtcctcccctgaagtggaaaaggtggagggtatcaagagagaatatagaaggcgtgttggagagtggttgtgcgctgggtccctgmaggaccagacntcgttccagaagatcttggaagatgtggagagcggctccgagattgtcaccggtccgctggaggaactggcctcctttgcgagggggaagctcgcggcagctagagtgcgacatcatcgtaagcacccagctgaggccgtgcctgcgcgagaggagcagaggtggatgaagcgcagggtgggtcgtcggggcttgtacctcaggttccagcggctttttgcnttggatcgcagraagcttgctgggatcatcctcgacgatgtcgagtccatcaagtgcccccttccgatggaagaagtcgctgacgtcttcaggagaaggtgggaggaggtcgccccctttaccggctcgggctcattccgaagtttggggaaggctgacaacggtgccttcaagcccatgatctccgcyaaggaggtcatgaagaacgtcrcggagatgtctcgacgctccgcgcygggwcccgayggcctctccctgcgggatctgatgaagattgatccccagggcagccgcatggctgaattgttcaacctgtggctgttggcaggacgggtcccggaccaagtgaaggcgggccgaacggtcctgatcccnaagtcggccgatcccgggaagatcgggaacattgacaactggcggcccatcaccatcgggtccgttatnctcagaatgttctctcggattttgagcgctagactgcggcgagcatgccccattaatagaaggcaaagggggtttatagcagcccctggctgctcggaaaatctgaagcttctccaggcgctcatcaagagcgcgaaacgagatcataggacccttggagtcgtgtttgtcgatttggctaaggccttcgactccgtgaaccaccagcatatcttccaagtcctggtccagaagggtgtcgatgggcatattatcgacatcctaagagacctgtataccaacgctggaacgtatctggagtcaggttcccagcgatcgggatttattaagatcctcaggggagtgaaacarggggacccactctctcccatcctgttcaatcttgcattagatcctttgctgtgccgcctggaagatcggggcctcggttataagtatggagaccaacaaatawcatcgttggcatttgcggatgatctcgccctgctcagcgactcttgggagggcatgcagcagagtattcgggtggtagaggaattttgtcaacggaccgggctgcgggttcaagcgccgaaatgccacgggtttttgatcaggccaactaaagagtcatataccatcaatgactgtgacccgtggacgattgcagatatgcaattggatatgatcgatccgggcagttccgagaagtatcttggcctagggatagacccatggattggtctatcgagaccggaactgtccgaggtgctgacccgctgggtgaagaacatcgggggcgcccctttgaagccactccagaaggtggacatcttgaggagctacgccctnccaaggctgctgttcattgcggatcacgcaggcctgagcgccacctgtttgcattccctggacctttcgataagatctgccgtcaagggctggttacatctaccgcctagtacgtgtgacgctattatttacgtcagctacaaggacggcgggctgggtcttccccgtctggcgagcctaattccaaatgtacaggctcgcaggttggtgcggatcgcccaatcggaggatgatgtcatcaggagtgtggtactccaggagggtatccaggaggagatccggaaggtctggatctcggctggggggcgaccggagaaggttccatctgtgacgggggagttcccagtgatggaggctcaggcggctgacgaggccctatccgagtgggagaggcgagctccacgaaccatctatcccattccctgtaagtggaggaagagagaaatggagaattggaccaatctaaaatcgcaaggccacgggattcggaattttgaaaatgaccgaatcagtaatgattggctcctgcattatggccgcattccccaccgcaaactaataacagctatccagttgcgggccaatgtctatcccacwcgggagtttttggcccgcggcctgggcgagggcgcacccaggggatgtaggcactgtcccgcggagtgggaatcttgttcccacataattggctactgcccggctgtccaggaggccaggatcaaaaggcataatgacatctgtggtgtgctggctgaagaggcnagaaagctgggatgggtgatatttatagagccccatctcagagataacaccaatgagctcttcaagccagatttggttttggtgaagggatcctgtgcgaaggtagtggatgtaaccatccgctacgagagtgggttaaccaccttgagtgacgccgcggcagaaaaggctaggaagtatcaacatctggcaggggaggtgcgggccctaacatcggccactactgtagacttcctgggtttccctattggcgctagagggaagtggtacgttggtaataatggactcctttccgaccttgggttctccactagccgtgtagtgcggatagcgagggccctctctaaaaaggctctcctatcgtccgtggacattatacatatttttgcgtctcgcgctagacaggcccaaacgtccgagtagggggcttggcatttctcattgcctgctcctgaaaggatatgggtcctgcgtcgcgtggtaggcagacccattcgtccgagtagggggcttggcagtntccattgcctgtgcccgaaaggacgtgggtcatctggtctgtctgcctacacctctctagacttgtaacatctagtctgtcaacaagatcaaaattcttcacacagacgaccgagcttgctcagtcttcctgtacccgcagaattttgctcttgctctcctttggctgtgtcctggacgtgggactattccatctcgtcccaaatgccgcgtccaattataccggatttgacaaagcggacggcccgctttataagccggaaaaggtgccttgtaaaattgcaaggttcattaaatag

SEQ ID NO: 1098 - DNA, 3690 bp, Trichinella spiralis
ctcctgactaacctgatttcgtccgtgcggcggcgttttcttttcgctctccgctcgtcgaaatttgctgtagttgattcgcttttctttgcgttttcttctactttcgcagttttttctgcattgccacgatgtcaaaccgccttgccaatactgctgcggctggtggggttccagagaaaacctcgggaactttagacattcctggccaaccctcttcatccggtgaaaagcgtgcgatctcttaccctggtccattcggttgcaattcgtgttcgtttacgagtacgacttggctctcattggaattgcattttaaaagcgtccataatattcgtgacttcgtcttcctctgctctaaatgtaaaaaaagctggccatcgatcaactccgtagctagccattaccctcggtgcaaaggtagcgtcaaggctgcagttgttcctacatctttggcgaatacgtgcaccacgtgcggctcaagcttcggtactttcagtggtcttcaactccatcggaaaagagcacatccggacgtttttgctgcttcttgtagcaaaaaaacgaaggcgcgttggtctaacgacgaatttacccttctggcgagactcgaagcaggtctggatccagcctgtaaaaacattaaccaagtactagcggaaaggttaatggagtataacatcaccagaggcgtagaaatgataaaaggccaacgtagaaaagatcagtacaaagcgctcgttcgtcaactccggtcaaattctgaaacacagcaatgtgtaggtttagccggaagtatggattcgaacgtaccggccaacgatacatcgtcttccgttgcatcagaggtcagcattacgtaccctgagtacggggccgtgatgtcgtgcgacctaattaaagaagcgactggtatggccatagttgacatcaacgagttgcaaagcaacttacgaaaagccttcttgtccggccgcaagcttcccatgaagttccatggagcgcgtgaaaccgcccagaagaaaatggccaacccccgtgttgcgaaattcaagcgtttccaacggttgtttcgaagcaacaggaggaaactggccagccacatcttcgacaaagcctcactggagcaattcggtggcagcatcgatgaggcatctgaccatttagaaaagttcctctcccggccaagattggagtccgattcttattccgtgataagcggtgataagtcaatcggagttgcacatccaattttggccgaggaggtggaattggaattaaaagcctcccgaccaaccgctgttggtccggatggaattgcactggaagacattaaaaaactcaatacttacgacatagccagtcttttcaacctctggctaaaagctggcgacctacccgcatcggtgaaagccagtagaaccatctttttgcccaaaagcgacggcaccaccgacatatcgaactgtcggccaatcacaatcgcatccgccatgtatcggctgttcagcagaataataacgcgacgtctggcagccaggttggaattgaacgtgcggcaaaaagcgttccggcctgaaatgaacggcgtattcgagaactccgccattttatacgccctcatcaaggatgctaaggtcaggtcaagggaaatttgcgtaactacgctcgaccttgccaaggcctttgacacggtgccccactcacgcattttacgagccctgaggaaaaataatgtcgacccggaatccgtcgacctgatttcgaaaatgttaacgggtacgacttatgcagaaataaaagggctccagggcaaacttatacccattcgcaatggagtcaggcaaggtgaccccttgtcgcccctattatttagtctatttatagacgagataataggtcgcctacaagcctgcggccctgcctacgatttccatggcgaaaaaatttgcatcctggctttcgccgatgatctgacgctggtggctgacagcgcagctggtatgaagatccttctaaaagcggcttgtgacttcctggaggaatctggaatgtcacttaatgcagagaaatgccgcactctctgtattacaagatctccccgaagccgcaagactttcgtcaacccagctgccaaattcatcatcagcgattggaaaacgggtatcagctcagaaatcccctccctgtgtgcgacggacacctttcgtttcctggggcacaccttcgatggagaaggaaagatccacatcgatacggaggaaattcgatccatgctcaaatcggtgaagtcagctccactgaaaccggaacagaaggtggctttgatacggtcacaccttcttccccgccttcagttcctgttttctacagctgaagctgacagccggaaagcctggttgatcgattccatcatcagggggtgtgtgaaggagatcttgcactcagtgaaagctggtatgtgcactgatatcttttacataccctctagagacggtggaatgggatttacttccctcggggagttttctcttttcagcaggcagaaggcactcgccaagatggctggatcgtcggaccccctctcgaaacgggttgctgaattcttcatcgaaaggtggaacatcgcccgtgacccgaaagtcattgaagctgctcggcgcgtctaccagaaaaaacggtaccaacgctttttccagacgtaccagagcggtggatggaatgaattttcgggaaacactattgggaacgcctggttgacaaacggccgtgcccgcggaagaaatttcataatggctgtgaaattccgttccaacaccgcagccacccgggccgaaaacctacgaggccgccccggcacgaaagaatgccggttttgcaagagtgccaccgaaactttggcacacatttgccagaggtgtccggcaaatcacggcttggttatccagcgccatgacgcagtcgtaacattcctgggggaagtggcgcggaaggaaggttaccaggtcatgatagagcctaaggtgtcaaccccggtcggcgcgctcaagcccgacctcctactcatcaaagccgacactgcattcattgtggatgtaggcattgcatgggaaggtggacgcccactaaagctggtcaacaaaatgaaatgtgacaagtacaaaactgccatcccggcaattttggaaacatttcacgttggccatgctgagacgtacggcgttattctgggcagccgcggatgctggctcaagagcaacgacaaggcgttggcatcaattgggctcaatatcacacggaagatgaaagaacacctgagctggttgacgtttgaaattatatttataactcaaataagccggatttataactcattcatgaaaaaatgaggtttttgttttcttttttccttttaccattcttgttccattgttgttatttgctttaatcctgtattttaccgccggcaattccattgttattattactgttactgttattattgttactattgtttttacttttacttactactgttattatactttaattcgttaacttacgttattgttaccactacttactttgctctctcgcaaacgttcgttgttgtttcttttggaccaggtttagagaaatcgcacgcacagcggaactggaccgcttaagccagaaatagtaaagtaacaa

SEQ ID NO: 1099 - DNA, 3894 bp, Tetranychus urticae
ctctcttattttaacatattcgatgtactcgtacattgaatatgcttttattttttttcaaagttttttgggtgcatacccctggaaaattctgagatgtataaatctcccatcagctttggctgaaacgttggctaagttttgtaggttgtttgccccctactacttagtcgcaaatggtatttgctaacagttgttaaattgttacatttacaagtcctatccagtgcctcctcgtggcgctacccggtaacacttagagtaatctgagtggctaaactggaagggcggaaaatgcaaacaggcggttggtagatgcttcggcattttgccaaaaatccacggctttttagcccaacaacatcagggtgatggacccgccagcttgtggtcaggatcccatccatgaataaagcatggctctgcttctggtgcatcctcaacgggatcggcttcggctggatgtaagtcttgcggaggcatgtgcatcttgggtggcctaacaagccattcaagagaaggagggctctcgcgagggagttctcaacttaagaccgttaagccacaaaacgaagaagataatggaactacccagttgaaggctgggagtgcggactctttcccaaggccaagtggtgatttgaacccagaggaaccactgagcattgatatctgtccagtttgtttcagacagatgaagagttatttaggcgttagagtgcatatgcagaagatgcacttagaagaatataatgcgtctattccggacccagtcgtttcccacactaggtggtccgatgaagaggcagcacaattagcttttactgaagctaagattgaggtcgacaagcttttacctcgtggcaaaggcataaataagttcctgttagagcttttgcctggtcgaaccttagagtctatcaagtctcacagaaaaagacaatcgcataaagacttggttcgcaaatatgtaaaggagttcgttgatactttagctgcagataacgatgacgataccatcatctgtcaagataatggtgacatttttaatgaccccatcgttggagcaactgattctcagtctgagactgaaactgtggctgatcctgctgaattcaagacttttattgagttagcagacgatcccacaaaaccaaaagtcgtagcaaaactcagaaacttgataaaagataaaccaaagagcgagatccttggaagtgacattcttgtacgaatcctgcgaagaactcttcatggcttgcctgttgaggacgagttggaccagtacttggaggtttacttcactgggaagataaagcagagacgttctaagacacaaactgccttatctaagaaacagattaagcagagagattatggacgtcttcaggagttatactcccggtctagaaaaaggtgtgcaaatgagatcttgaaccctacttctatgagtggtggttttggtcatcaggagctatccgaattctggacaaagacgttcggaccagatgagcaacctactctgggcgaggtggagatcattccgaaggagaactgttggtgggatattttctcgccaatatcttcagacgaaatcaaagcctcataccccagtatagggaaagctgctggtccagataatttctctgcttatcaacttagaaaagttccggtttggcatctggaatgtctctataatatctttgctttctacaaggacataccgagtagacttaaagacgcgaagacaattttgataccaaagaaggataacgctgaaagtccaggtgatttccgccctatcaccttgagctcaattatcactcgacattttcacaagattctagcgacgagagtgaataattttgttcgattccatcctatgcaaagaggcttcattcaatctgatggttgtttggagaacactgcgctcatacagacggtcattagagaagccaaagtgcgtaggaagcaagtgcatatcaccttctgtgatgtgcgaaaagcgtttgacagcgtccggtatgactcgatcatagcagctattgcaaagaaaggtgcaccaggaagtttcatcatgtaccttagtaacttatatagaggaaataagactacgcttttgactgctggcggtgaaacaagaataactccaacacggggcgttagacaaggagatccgttatctccgatactttttaattgcgtgatggaccagattctcacggctcttccttcgagaactggttttacgttatctgctggtgacgaatcagttaacgttaactgtttggcgtttgctgatgatataattttaatctcaaagaccaagaatggacatcaagaactccttgatgtaacacaaagaattttaaaggagaatggcctcgatctcaatcctgataagtgctgttcgctaagcttgataccgcacagcaaaacaaagaaaatcaaagtggttcgtgctgacttcgtggtgaacggagtcaaagtgcgatcaatgagtattggtgattcaacttgttacctaggtgtctcaataaatgtaactggccaagtagcaccagttaaaatgtatcaggctctgtgtgagaaacttgatagtgctgctattaagcctcatcagagactgtacatattgaagcatttcgtaataacgaagatgtttcacccgctgattttgtcaactattgcggcacacaagataaagaatctggatttgattagcagacgttatgtcaggaagtggttacacttacctcatgattgcggatctggtatgattcatgccaaagtaagcgatggaggattgggtgttccattactgttcaggacaattgctgatctcaaagttcggagaaaagaaaagctgcaggtccatgaaaacccaatatttagaatattggcaaagctatctacagtaagcaaggagttggaaaattgtaaaaagatagcttccaagacgacagacattcaagaaaagactttcaaggaaatgcttgcgacttatgatggtttgtcattgaaagaagctcgagcggtacctgaggtgcacaaatgggtggacagctatgataagcgttataagtttgcaggccgagatttcgttcaagttatacaggctcgtttcaatgcgttaccaacgagatctcgagtatggcggggcagaggtgctgatgaaaaatcgttacgttgcagagcaggctgcaacgctagggaaacgttgaatcacgtttcacaatcttgcttcaggacgcatcgagtacgaacagctagacacgacaaaatcctggattttatttgtgaaaggctggacgtagtcggtgttaaatacgtacgagaaaagccaatcagctttcctggcaaaaagttgattcctgatttgattgtggaaaacacggaccaagctcttgtgctcgatctccagattgttggcgataacagtgaacttccacttgatgaaagaggcaagaacaaggttatcaaatacaattgttcggagatgcaggaattgtacaagaggaagaaaaagactttggcggttaaggcactcacgctacattataaagggttgatggcaccggaaacaagcaatatcctaaggtcattcggattcaagtctaaggatttggaaaagatggcgtatatggcgttgtttggtacggtggctgcttggggcattttcaatcgctcgacggagacaatgcgttcagtcgctaactggcctagacctgaggaattatgatgtatcccttcaatatattgtaatcctcattcgtccctatcctttcatttgataaaagaaactttgttgctccttttaatagttggtccctcctgtcccttttctggaacctggttgtatcgattattgaaagttgcaataaacggatttaa

SEQ ID NO: 1100 - DNA, 3554 bp, Drosophila willistoni
  modified_base (3536)..(3536): a, c, t, g, unknown or other
gaagctgggaagctgggtcggatgagcgcagaaggggtgttcttcggagcactgtaattcataagtcgtaagtctgatcaagtcgactcggaacctcttcgtggtgtttcctgggtgctgttgagttcctagtctctaggttctctccagtagctaattcgagcggcgaagcaactcttggggttaccagaaccttgagccaagtaacgttggtcaagatatgaatactgtgcctcggataaacaacacaacaacaactccagcgacttcccgtcctggagaccaaccgagagaggctatagcagtggtaaatctcgcgggagagattccctgtgcagtatgtgggcgcctcttcaatactagaagggggtttggggttcatatgtcacatcaacacaaagacgaactagatacgcaacgtcagcgtgaagatgtaaaactccgatggagtgaggaagaagcgtggatgatggcgagaaaggaggtggagctcgaagcaagtggtaatttgagatttcctaataagaagctagcggaagtatttactcaccgtagctccgaagcaattaaatgttttcggaagaggggtgaatataaggcaaaactggagcagatcagagggcaatctactcccaccccagaagcgttggactcaattacctcacagcctcgccctagtttactcgagcgaaaccaccaagtatcatcgtcggaagcgcaaccaatcaatccatcagaagaacagtcgaactgggaaatcatgcggatactacagggctatcgccccgtagaatgtagtccccggtggagagcccaggtcttgcaaactatcgtagatagggcgcaggccgtagggaaggaaaccactctccaatgcttatccaactatctcctggaagtatttccattaccaaacgaaccacacaccatcggtcggagcaatttgcgaagacctcgaactaggagacagttaagacaacaagagtacgcacaggttcagcgtcgttgggataagaatactgggagatgcattaaatccttgcttgatggaacagatgagtcggttatgccaaaccaagagataatggaaccctattggaaacaagtaatgacgaatcccagcacatgctcttgcgaaaacacaagattccgtatggaacattcgcttgagacggtttggtcagcgataacgccacgcgacctgagggaaaataagttaaagttgtcaagtgctccgggtcctgacggtatcactccaagaacagccaggagtgtacccttaggcattatgctacgcataatgaacctgattctctggtgcggcaaaataccattctctacccgactggccagaactatcttcattccgaagactgtgacggcaaatcgaccgcaagactttcgtccaataacagtcccctcggttttggtcaggcaattaaacgctgttctggcttctcgattggcttctaaagtcaactgggatccaaggcagcgcggtttcctacctaccgatgggtgtgctgataatgcgacgttggttgatctcattttgcgggagcaccataaacggtggaagtcatgttaccttgcgacggtggatgtcagcaaggcttttgacttagtatcacaccaggccattatcaagactttacaggcctatggtgctccaacaaactttgttagctttatagaagaacagtataagggcggcggaacctccctcaatggggcaggatggagttcagaggtgtttatacccgcgcggggcgttaagcaaggtgaccctctgtctccactattatttaatcttatcattgatagattacttaggtcctaccccagagagattggtgccaaagtcggaaataccatgacaagcgcggcagcgttcgcggatgatctggtgctatttgcggaaactccgatggggcaaacattgttggataccacgctaggcttcctagcctccgtgggactctcccttaatgctgataagtgtttcactgtcagtataaaggggcaagccaagcagaagtgtactgtcgtagaacgacggagcttttgtgtaggggagcgcgagtgtccttcattgaagcgtactgaagagtggaagtatttaggtatccggttcactgcggatgggcgggctcaatatagtccagcagacgacctcggtccgaagctgttaagattaacaagagcccctctgaaaccacaacagaagttatttgcacataggactgtccttatcccacaactctatcaccaactaacacttgggagtgtgatgataggcgtcctaggaaaatgtgacagattggtacggcaattcgtaaggagatggttagatctcccactggatgtaccagttgcgtactttcacgccccccacacttgtgggggtctcgggattccgtcaattagatggatagcaccgatgcttcgtctgaagcgattgagcaatattaaatggccccacctcgaacaatccgaggtagctagctctttcattgacgacgaattgcaaagggctcgagatagattaaaggcggaaaatgtgcagcggtgttcgcgtccagagattgactcgtatttcgcaaataggttgtacatgtctgttgatggttgcggtctccgtgaagcaggtcattatggcccgcaacatggatgggtgagtcagcccacgcgcttgctaacaggaaaggaatatttgcacggtgtcaaattgcggataaatgccctaccctcgaagtctcgtacgacgaggggaaggcacgaattggagagacggtgtcgtgcaggatgtgatgctcccgagacaacaaaccacatcttgcaaaaatgctatcgtacgcatgggaggcgggtagctagacacaacagcgtagtaaatgccgtcaagcggggacttgaacggaaaggctgcgttgcccatgtcgaaccaagtctgcaatgcgactcgggcttaaataaaccggacctggtgggaatccgacagaatcacatttatgtgatagacgttcaggttgtgacagacggacattccttagaccaagcgcaccagcgcaaggtcgaaaggtacgacagagctgacataagatcacaaatgcggcgatttttcggagtgacaggtgaaatcgagtttcattccgttacactcaactggagaggaatctggagtggtcagtcggtaaaacgattgattgcaaaagatctcctcatcgctgaagataccaaactcatcagcgtcagagcagtaaacggcggagtgacgtcttttaaatatttcatgtattgtgctgggtatactcgaagctagatgtactaacctctagtttctctatacttttgcctgctaccttggcattacatctaaaaaggtacaaacatcgcattggcaaaaagaggtggttttagtacataggcgctgtgggacttcattgtcccgatgatgcagcgaatcgtgcatacgagattgtccagtagttggttgctcgtatctttagaagatttccttcctcggcgatcaaaanaaaaaaaaaaaaaaaaaa

SEQ ID NO: 1101 - DNA, 3955 bp, Petromyzon marinus
cggtgcgttcccttgggtaaggaacacgagtcttagtggccttgacctccacgtggtcccgctggtaacatcatctcttgatgatggctaacaaggctaatgcacccattccatctcctatctcgcatggaggccgctatgcgtgattactagaggccacaaacaaaacttatgactgacaaacttaagttctcaagccagttggcacgaggcctggcaaaacaacgtgctatggatggcgctcgggttggcgatccacccattacagttagacccacagaaaccgatctgtgcaacactgagggttcatggggacgccgtcctatgaaactcttgtttgtctcggtgtcaacccagacacagaatgaagatgccctctgggcatctgatgttgctaaacctatggcgtctaggtcggcgctaaaaatgacgagtataccttccatgaccttccataactcgtccttggaaaaggaagaggagatgaactacgatttttacgaacagattaaaagtctagttgagtcggatgactcttcagatgactttacagaggatgatgaggatgtggaggagtccttcctcgacatatcggctgaggaacccgtgttgggaaagtttcccattgacaccaagggaactatcacggttgtactgcctagtctggagtatatatgcgttatctgtaaacaacacatgggcaaagcatccgaacttgttgcacattttaacatcaaacacagagacattcctctggtgtttaagtgcgctaaatgtgacaaaaccaactcaaaccaccgatcgattgcctgtcatgcccccaaatgtgggggaataaagttaactgaggaaagcttaccaatggtctgtgaatgttgccaggcacgctttgcgactctaagtggcctttcgcagcacaagaggcatgctcacccagtcacccgtaatgaggaaaggattaaagatggtataaagggtacctcgcagagaggggtacaccgtagctgctggtctttgaaggaagtagaacagctggcccttctagagttgcagtttcaggggaaaaagaatatcaataagatcattgctgaagcgcttgggactaagaccaacaagcaagtctctgacaagagacgggacctaagtaaaaagacaggggcccccatgtcagacagcttacatttttcttctaggcctcttgagacattgtctcccccaccaaatgtaacaacggggacttcatccatactcgctcaagcagctgagcggcttacgaatgagaattctgggaccctggaaaagcctgcaatggaggcaataaaggcttggcttaacggcgagggccaacatgatgccctcgtagaaactgccacagcattgatgctttgtccgatgagattggtgaaaaacaaaggcaaacgttcaaaacccgagaacgacattattaaacccaggatattacccacacgatcttggatgaagaagagagcggaaaaacgaggaagcttcatgaagcaccagaagctcttctttaagaaccgctctcttcttgcgtccttagtcctggatggcactgaacgtcatgaatgccgaatcccgaacgcagatgtatatcgtttttactgcgaaaaatgggagaaggtgttgccattcaatggcctgggccaatttaagtcatcaggtgttgcaaataacgaatactttgagcccctaatttcggtggaggaagttcagactgccatacgggccattaaaccaacgtcagcagctgggccagatggcctaacaagggctgcaatctgtgctgccgaccccgagggtcggacactgacagccctatttaatgcatggatgattacaggaattattcccaaagagttgaaaaagaataggacgattcttattcctaaggttatggacgatgaaaagctgaaagaattggggaactggagaccaataacgattggttcaatgattctgagattattttccagaataatgactgcacgtcttgctcgtgcttgtcccttaaacccaaggcagcgtggttttatagcggcatctggctgctctgaaaatcttaaggtgctacaggaccttatgagacacgctaagaaattgcacaggccgttggctgtcatgttcatcgacatagcgaaagcttttgactcggtttcgcatgctcatattttatgggtgttaaggcacaagaaagtagatgaacacgtggtgggcatcatccagaacgcctacgatcggtgtacgacctcgttcaaaagcaatggcgagtcgactcgagaaattagcatacgtgttggtgtcaaacagggtgaccccatgtcacccctgctcttcaatcttgccatggaccctttgatatgcaccctagagtcacacggagttgggtactccattgataccgaccacgtgacagctcttgcgtttgctgatgatttggtgttggtgagcgaatcttgggttggtatggccgccaatctagcgatcttggaatcattttgtgggctatcgggattggaggttcaggccagaaagtgccagggcttcatgataagcccaaccaaagattcatatacggtgaacaactgcgacccatggactatcaaaaataaagatgtccatatgatccaacctgatgaatcaacgaaataccttggtctaaaaatttgcccttggactggcattatacggtcggatctacatgttcaactaaagacacggatctcgaaaatcgatgaggcgcctctgaaaccgactcagaaggtcgaactcctcaatgcctacgccctacccagattattgtaccctgctgaccactcggactgcaagcaatcaactctccgtgtgttggaccaagaaataataaaggcggtaaaaggatggctccatcttcccgcgtcaacctgtgacgggctgttgtacgccagagcccgagacggaggccttgccatcttgaaactggaaaatgcaattccttcggttcaagttagaaggctgcaacgtattgcaaactcctctgacgctatcgctcgaaacattgcgtcctcgcagggtgtggaggaagagtaccgaagtctgtgggtacgggcagggggtgacagcgaagcaatcccaacgttctttctcaggggttcggaatcaaaagagcccgtgtatccgagaccctgcgattggaggaaacgcgaatctcggagacggtgcgaaaagccggttcaaggaaggggcattgtaaactttgcgcaagatagaatcagtaatgcatggttggggccacggtgcggctttaaacaatgcttctttatcgcagcattacaattaagggcaaatatttacccaacaagagaaagcataaacagaggcagagatggtgcctcacggtcctgcaggaaatgctctgccaggctggagtctctctcgcacattcttggtcaatgtcccgcagtacaaaaattcaaggattgcgcgacgcaataagatcagcgacattctagctgacgaagcggcgagactgggctggtgggtgtacaaagagccacggttcacatctgaagccggagagctaaggaaacctgcccttgtgtttgccaaaggtgaggaagcgcttgttattgatgtcaccgtccggtttgagctctcgaggaaaacctcatcagaggctgcctcgcaccaagttgcgtactacacccccccttgtgatcaagtcaaagtgctgacgaaggcaagcaatgtcacattctttggattccaggttggggcaagagggaaagtggccccttgagaataatgaggtgctaacctccctgggcctgaccaaacccagaacacatcactggccaagatgatttcccgcagcacgttgcttttctctctcgatacccgagaatgttctgcggaactacgcagtctatgaacagtcacagacaacctctgatccaag

SEQ ID NO: 1102 - DNA, 4002 bp, Schmidtea mediterranea
agtcatagggtgaactgcaattctgacacgatgaccgagctgtgtcagtttgcagctagtcgctaaagactcgatcagtccgccaagtgaggtggccgggtatctgcagcactagagccactggtatcaagagcagagatacgcgagtggaagttgagtacgactaccttcacggggtcctcctgataaccacagtggactgtgggaactaaatgtgtgctcagcgttccctactttctcgtagggtaaagggtatgataacccagagaatatcccatgggagatatccatggaaaaagcaccacgttagacaatccgatggtctaactcggctccgaggggctaactatcccaaagggcttaaagaaaagaactggttacaatcaaaaatctatttgaagagtcaggtgccaccgcgcctgcaccagttcccctagaagttgcagttgaggtacaccagtcatcgagtgttcccgagataaccgacgaatctacgactactcaggaaggaagctattcagaaccaccgatacaccgatgtgagaactgtggaagagaattcagaacaagagcaggagttcaacagcaccggagaaaagctcacaccaacgagtttatggaggagaaagagaaggcagctccaaccaagaagcttcgatggacagacgaagaaaaagagatcctcatcgaaagcgagataaagatcatcaaggaaggatcccttaaagaacaacacgaaataaacaagattctagcttcaagaatgcctggaagatcacaagacggaatagccaaaattcgccagaaacaagagcacaaggctgaaatacagagaaggctacatgggaccgtcactaccaacgaaaccagaggaaacagaaccagcgaaattaccgaaccaataagaagcttaccaataaacaccaaaacctggagcgaagacgaaatgaaaagaatgctagccgaagaagtgaagttgagaaccaagaatgaaaaggatatcaacaagaagctagcagaaatattcccgaacagaacaatggggtccataaagagcaaaaggacgaaagataaggactaccaggatttggtaaagctaacaatgcaaacaatcagcgagaacccagacaatgaaacagacttcaataccagcaacacggaaaacaacagcactgatgcagagaaagaagtgaagaactacctcaatatgctactactgaccatcaacgaggaagaatggttgacatccactctgaaggaagcagcaacactagcactacaaggaaagaaaactgaagcatctgaaaagcttaacgagtatgcaagcaaaacgctgttccctggattgaaaataactaatcagacgaggaaacgagaaaagaaaatatcaaaaagagaaaccagaaggcaagaatacgctgaaatacagaaactctacaaaaagaatatttcaagcgcagccgaaaaagcaatcaatgggaaatggtccataaaacccgaagaagaataccacaacaataaggatctcattaaagcatggaaaccaatactagaggcacctccattcagtgactgtaggcccatcgaaaacatcaaggaaatggactacgctttaatggagatcagcacggcagaaatcttcctcgcaataagagccatggggaagactgcaccaggacctgatggcattaaatattcaaagctcaagaaaaatatccaatcaatggcaatattattcaacacatgcctactaacgagcttcctgccactcccattgaagatagcaaggacaatcctgatacctaaacaagagaatccaggtatccttgactatcgaccactaacaatagcctcagtggtgacaagagtgttccacagtatccttgcgaagaagctcgacaacaatgcccaattaagtcaacgacaaaaaggatttcgaaaatgtgatggagttgcggaaaatatagtaatactcgaaactatattaaccaacagcagaagtgaaaagagaccgctctgtatggccttcgttgacttaagaaaagcattcgattctgtgggacatgagtctatcatcagaggagcaaaaagagttggagtgccaccaatgttgctcgagtacatttcktcaagttaccagaatgcgtctactaacttgttcggcgaaatactcaactcgagaagaggagtcaggcaaggcgaccctctgagccctattctcttcaattttgttatcgatgaagctctagaaaacctcaacaggaatattggatatctactgaaggaagaaaaagtgagttgcctagctttcgcggacgacatagtcctgatagctgagacaaaaggaggcctagagaatcatatcgagaaactattagagaagctgaatggggccggtctcgagttgaacgcctcgaaatgcgcaacactgatggtgatgaaaaacggaaaggaaaaatcaacgtatatatcaacaaaagcaatcaaaatcaaagaaaatgacattccaacaatgaaagccacagaaacgtacaaatatctcggattgcaaatgggtttcaaagctagagaacagaatgctaatgaggttattacagaaggactggagaatataacaagagcaccactgaagccccagcagaggatacatatcctacgagacttccttataccaagattaatacacaaattggtattaggaagagtggccaagaagtcattaaaaagaatcgaccagaatataagaaagaaagtgaggaattggctacatctccctaaagacacgacagcagcattcatacacgctgatgcaggagatggagggcttggagtaccagcgttagaacacacaattcctctactgaaaagagaaagaataactaatctaagaaaatccaatgatccagttaccaaagaatgcctgagaatggagtacaccaaacaagtactgggaaaatggagtagaccaactaaaattggagaaactctggctaccaacaaaagccaactaaaagaagcattcagaaaacagatgttaataacgctagatggaaaagggctaaaagatcaccacgaaacgcccactatccacaaatggatcagaagaggagagaacatgaccggcaaacagtttatcacagcagttaaaataagaggaaaccttgtggcaactaagtcaagaaatagcagagggagacccgaacaagagaaactatgtgaagctcaatgtggacgaccagatagcctgggacacatattacaaggttgctggagaacacatggtatgcgagtggaaaggcataacaacatttgtcgcagaattaaagcaataatgaaaggaaaggaaagcgaagtagtcgaagaaccaagactacaaacgaatgaaggtctcagaaagcctgacttactgatctgtcacaaaggtaaaataataatatgcgatgcacaagtagtggcagatagctcgaactgcagtcttgaaagcgaaaaccaaagaaagatagattactacaagaaagattcagtagtatcagaagcaagaaaacttatcggacgtgtcgacgaagatataattataatggcagtgacctttaactggagaggagccatctcaaaaacatcaataagagatttggacatgcttctagatataaaatcaaaagaagtaattaaaatgtcaaggaaaataatcagagataatagcatcatggtggagatgcacagaaaccggactgagaaaaggagatagaagggaaacaaaggaaaaacgaaatgactggaaactatgaaggatatagctgaaagccgcaaggaaggctaagtcctgaaaccgatctacatcttcgatcccaagaggaactgtgggttaagcttgagccgacggaaaaagcgaatgcatgttagacgacgaggtacagtcacctcctcgtggtatttggcgggcaatgctcactaaattaactgtgagtagctgagaactgtatgtgtatcatgaaaaaaaaa

SEQ ID NO: 1103 - DNA, 4161 bp, Tribolium castaneum
tggaagaccccgcccatgaggcttggagagtgtgatcctgatcacacttgaaaagttatgctgagtacgtcgtgagagtcggtaactgtcccaggatggtctgggataggctaaacctcagcaggggaaagttgtaggggcctgccacccctacacttttatagatatggcattcgatacctcaaatagagcctcggacttggaggagcatggttcccctcctcctcgtactagacctggaaccaacggtcttgacaaccccattggacctacgggagcggaccatgctcatggacatggattccgaagacgaagcgggggaacacggaccccccgccgataatgctcacttaacgtcaggcgaacccatcgaaatcatcttgatgttaccctttcaaagcaggtcatgcggcatatgtctcaatgccggaaagggtggctcccgggcgtaacggacatctatcgctgatggaasctagctcgctcttgaagaacggcggacggggacttggaatcgtggtgtggttctgatgtaagtcctgaaattatggcgtgatggcccgcccgcccgaccggagggacttagaacccccttccgcgagggtcctgtctgtaggtccwccatctccgtaaaacgagttggaggaaaccgcagacggggatgaagagtcgttcgttccgtcgcatcggggattgcgcagctgggtcaagtcggcggggtgttcggctaacgggcaaggctgggcgtgaggggaggtttgcagcttcccctcacttaagcccacgttatcttgcaggctcggtttcaggtaatgttccttcagttccccccggccccggcctgggggccggggctcctgcatttgctgctggtcggaatgccgatggggggcccgcccaaaatccgtgcccgtattgtgcacggtcgtttactaccgccaatggccgcgggttgcacatacggagggcgcatccagacgaggctaataacgccatagacatcgaacgcattcatgcccgctggtcacacgaggagacagccatgatggccaggcttgaggccggtgccatccagcgagggggtgtaaggtttatgaaccagtttctggttccgcgcatgccgggcaggactctggaagcggtgaaaagtaagcgcagagatgcgacttacaaagcactggtccagaggtttctgcaggcgccgcaaataaacctccccgaactgcgtgatggtgatgcgcctcgtcagcctgatcctcaacaggaaaaccctcccgagcccccttctttcgatggggcgatcaggggcgctgtcgccgaccttgtcggaggggtcgactggcagcgcctcgggtttcagggagaccgtctctgtaacatcgcgagacgggcttgcgatgggggggatgtttcgggccagttgctgggctggctgcgggatgtcttccccgtcaagagggttagtactagaggggatcagagcgacctagatgtcgacggcgcattggtgagcaggcgcacggcgaggacaagggagtacgctcgggtgcaggagctgtaccggaaggaacctaaggcgtgtttggctcgaatccttggtgatcgtcgagagggggccaatcgggctcctaatcgcgatcccgcattcatcgatttttggcgaggcgtcttttcggaggcgtccgctgaggtcgagggatgggcggaggaggtctccgaccatggtgagctggcacgccgggtttgggaccccatctctgtcgaggaggtgggaaggtctcgggtccggaatggtgcagcgccggggcccgacggaatagcggtttccgtgtggaacaagcttccgccggaggccgctgcccttcttttcaatgtgctgctgttggggagatgtctgcctgcagaactcacccgcacgcgaacggtctttattccaaagaccgacgcaccgcgaacacctgcagactatcggccgatttcgatcgcgtcggtagtcgcacggcacttccaccgtgtcttatccgcacgtgttcaacgcattcccgacttgttcacaaagtatcaaaggggcttcttaagcggcgtggacgggatcgcagataatctctcggtccttgacacaatgctgacgatgtcccggagatgctgcaagcatttgcacttggccgcgttagacgtgtcaaaagcatttgacactgtctctcactttgccatagtgcgtgcttgccggtccatatttgggagtgcggagaccgtgttggaggagggcgggaggaggcacttcgtgcaagtgcggygtggggtgaggcagkgagacccactctctcctctcctctttaacctggtcttggaccgggctctgaagaggctgtccaccgatgtgggctttcgtctaacggatgcgaccaaagttacggcactcgcttttgcggacgacgtcgttctgtgcgcgaccaccgctagaggactccagaccaatctggatgttctcgaagcggagcttcgcctagccggtctcttgttgaaccccaacaagtgtcaggccttatccttggtggcttccggacgggaccacaaagtgaagctcgtgacaaaacccacctttaaggtgggacaaaacacgattcaccaagtggatgcgtccagtatttggaagtacctgggaatccagtttaggggtagtgggatgtgcggatgcggttcggagggtgtggctgctgggttgaagcggatcacttgtgctccgctgaagcctcagcagaggatgcacctgctgcgagtctttttcttgcccaagttttatcatgcttggacatttgggagactcaatgcgggtgtactgcgccgtctggacgttgtggtccgaacttcggttcggacctggctacgcctcccccacgatataccggtgggatactttcacgctcctacgaagtccggggggctggggatcccgcagttgtcacgattcatcccgttcttgcgattaaagcggttcgaccggttggggcgttccgcggttgactatgtccgagagtgtgcatttacggacattgcggatcgaaagatccgatggtgccgtgagcgcctctcgggcatagtggaccaagtcgcgggtgggcgggacgcgcttgatgcatattggacagcgcagcttcatcagtcggtggacggaagagcactaagggagtccgcttcggtggcttccagcacgcagtggctccgctgtagcacacgtgcaattccggcctctgactggctgcattacacggctgtccatattggcgccctaccatcgcgtgttcgcacatcgcgtgggaggcggggcggccaggatgtctcttgtcggggtggatgtcttctggacgaaactccggcacactgcatccaggtttgccaccgcacccacggggggcgggtgttgcgacacgacgccatcgccaagcgcatttctgccgacctgatggaacttggatggatcgtaacgagggaggtttccttccggacgactgcgggtgttttccggccggacatggtcgcggtaaaggagggtgttaccgtgatcttggacgtgcagattgtttcaccggccccgacactggatgaggcccatcggcgaaaggttgccaagtatcgggacagggctgacctggccaggtacttggctgaggctgcggttgctcgtgggcgtgcgccgcctgcgaatatacgatttgccagcgcgaccatctcttggcgaggcgtttggagtgctgagtcggtggggtccctgcgcgagctggggctctccgctcggcacttcgatcgctatacaacgatggcactctgcggttcatggagaaattgggtgcggttcaatgcgtccacggcctctcggatgggtcgtggacgcggcgacgcgagtcctcggaggcacgaaaatcagcagtgatgctcctttggttttaccatctgtgggggcatcggtcctcacggtttcctcgggtttcctattgtttttcctaaacccgacaaggagccctttggccctcctccttaaacacctctccttcatcctsttagtccattccggctaaaatgatgaagaccgaggagtgtcactctcttggcggggttaacccgtccaagtgtaaatgtgacctcgccattcgggctctgata

SEQ ID NO: 1104 - DNA, 3609 bp, Megachile rotundata
tctagttagcaagcggccccctctaatcgggtcccgccacgagtaccttcggggaaaccaagagccgcctctgcgaacctacctccgcattgggttgccggcccggtgcggttgtaattcagtgggcccaaattcacaaggaaaagagaaaaagaattgtcggttggcccttagggcatctcggatcaccgacctcactgaaacttcgacacccgcgcctgcaagcgaagcgcatagttccagtgcttgcggagttgatgcaatgtttgtgtgctcgacatgtcagcggccgttcgccacaaaaatcggcttgggcgttcacgttagaagagcgcacgagtgcttgcggagttgatgcaatgtttgtgtgctcgacatgtcaaaggtcgttcgccacaaaaatcggcttgggcgttcacgttagaagagcgcacgtggaagtcgcaaacgctgccatatcagtggagcgcgttaaggatcgttggtcggaggaggagcgaagaataatggctgccgtcgaggttcgaggagtactctctggggctcgttttataaacgagtacattatgagtcatctccagaccagccggaccctcgaatctgtcaaaggaactcggaaaaaccccaaatacaaggaacttgtcgcaaccttactggaagaggcacgaaccagtgtgcgggaggagagtcctcgtagtgcggtcaacgatagcgccacccaaccatcaggcccctctgatacacgaagcctgcgcaccgaacacctgttcactgaaagcaccgagcctttcgaacatcggatccgagagttgatcggggatcttgagggagtgaccgacttcagagctgagttgctggtttccattgcggaacagcagcttcaaggcgatgaggtggcggaatccctgactcggtggcttggcgaggtttttaaacccgagaaccaacaacaacaggttcagcgtaagcgtcggcgacaaagaaaggcccctgtcagtgggcagctgccaaagtggcgcgagaggcgaagggattatgcagcgatgcagactctcttccatcggaaccccagtcttgctgctggtcgtgtgctggacggcaagaacgagtcccggcccccggatctgccagaaatgacagcgttttgggaaccgatactcaccgagcaatctgccgaacatcgggcagttgggccggcttccgagaaatcggagttgtgctcagtatggggtccagtagagaaagaagaacttctctcctccgtgccgccgttggacacggctgttggccctgacggtgtcaccgccagacaatggagagcggttttaccggccgttagagctctcttgtataacatcatcctcaagagaggctctttccccgcctcgatgctggaaagcagaaccgtgttcctgccgaagaagcaacatagtgtcaatcctgctgactttcgacccatcagcatagcgtcggtcgtcgtccgtcaattacacaagatcttggccatgcgccttcgccgtacgaacctcgttgacgaaaggcaacgatgcatggatgacggatgtgccgagaacatcacggtgttggcctcgctgctggacgatgcgaggcatggtctgaaggagctgcatctggtttcgttggattgtgctaaggcgttcgacagcgttagtcaccatgcgatcgacgcaacactaaaagaatgcggtctgcccgcgggatttgtgcaatacatctcccgcacatattccgacagttccaccaggctcgaggtcggaaggaatcggtcggagccaataaagaccaaccggggagtgcggcagggtgatcccctgtcaaccctcatcttctgtctgtgcttcgatagagtcgcgcgtaccctctcaccacacattgggtatgaccttaataacacccgcatcagtactctgctttacgctgatgatgctttccttgtctcgacgactgctccggggatgaacatcctgctccggagtgtggaggaaagtgccggtgaggtggggctttcttttaacacctcgaaatgctcagccctctccttaattccatctggaaaggaaaagaaaatgaaggtcggaacgactccgacgttcaaaacgtcgcagggttttattacccagataacgccctcgcaagagtggaggtatctaggagtcgacttccaatactccggaccgaaaaaagcaagtcggagtctcaaaatcgagctggaacgcatttcgaaggcccccctcaagccgcaacagcggcttttaatcctcagagtctacctgctgccgcgatattaccatcatctcgtactctccaggacaacccttggtcaccttaggggcctggacctgcaagtgcgcgcggctgttcgtaggtggctgtctctgccgcgcgacatccccattgcctacttccacacaacagcgaaggaagggggtctgggtcttccggcgtttgagacgtccattccatgcctgatgttagcccgcttgaggtcgatggaaacctcgacttgcaaggcggctagggcggcggttcaaggcttctgggtgcagaaacgcatccattgggctacggccgctctcactaagaacggagaagccctaacatgcaaggcggacgtcgatcggtggtgggccagtaggctccacaagtcagtggatggtcgcgaactgcgtgagtgctcaggcgttggctcgtccagcacctgggtaaattctgcgcttaacatcaccggcagagattacgtgcagtatcatcacgtccgcatcaattctctcccgactcgcattaggacatctcggggtgtgcgaagagaggggatggaggtcacgtgccgcgctgggtgtcaggtaactgagaccgcggcgcatgtcatccagtcttgccaccgcacacatggaggtcggattcttcgacacaatgccgtgtgcaaagtgctggcgtccggccttcgcgacaagggatgggaggtgcgtgaagagccaaaactgcgaacgcgacagggtctgaggaagccggacatagtggcgataaaggacggcgtcgcaagggtgatagacgcacaggtcgtgagtggatctggaccgcttgacgaggcgcatgagaccaagcgcaagtattattccgacaatggcgacgtaactgctgcgattgctcgtgagtgcaacattgctccatcgaatgttgcatactcgtcatgcactatctcttggaggggtgtgtggtcgcctcggtccgctgcagacctactacaggtgggtctgtccaaaaagctcttgggtttcatcaccctaagggtcttgagaggcagtcatctaaattggacacggtggaacaaaatgacaacgatgcgcgtacaccatcagcgaacaggtatcgggtaaatgtcgaaccgaattttgggtaacgtgcaccccaccatccttaatcggcagcacgcaataaagccgtgggcagtggttttagtgggtagtcattaggagtcccacagtacccagcgaacatcttagtgggtctgcgtaaacgcatttccactgcctatcctccgggaaaaaaaaaaaaaaaaaaaaaaaaaaaaaaaaaaaaaaaaaaaaa

SEQ ID NO: 1105 - DNA, 5002 bp, Apis mellifera
tggtaatcaaatgcctcgctattttagtagcggtagcgctccgcccgcgcaggaaccattgacgccgccgtagtgtgggtgattttatatccaaccaatcacgtcaactacgatcatttgtaatcaccgacggtacttggtaggggtaccacatgggcattcttgctcattccacaacgccgcctccatcatggcaacaatttaaaatatatataaattcttaaggtttgaccgtattcatatatatatatatatatttaatattacaaccataaatcttatatcgagccttctatttggtctcaaaagcaatacgttgtcagatcttgtagaacatcaggagtgagcggtgcgctgtggtatccgtgctttgtgccgcggcgacaaaccaatacgctgctgcctgtcgcaaagcaatacgctgctgattctcggatgcgggtgtcgacggtcacgcaaagcgatacgctggtggggtttcaaaacaatacggcgctggtgctaaaaagcattatgccgctaacggctggattgtcgatcgccgctgcgggggctagtggcgcacccagagaggtgcgacgcgcaagcattggttctgtgcgaagcggagttcttgagagtaatggttgctgggggcacaaagcgcaacatatagcctcttatgcctcaagtcgtagttcgtacctccacgtggtcccgctggaatgcctatcgactcctccccggaggatcatagagttcgaaaccggctacggcgaggcaagggcggtgaggtgcacaccgatggggagcagcgaccccacctacccttagctaagagagcaggcgatccgccaactgtcagcacgaaataaactaatcatatgtatacgagggagaatttacaacgggtaccttgtgcccgaaccgcctgtaggtatcacctacaggtgttaaaatgaatctgatagctggcggatcgtcgaccctctttgatggctctgcgccaacgactggaaagaataggaacggaagtctaatggaaggaaagtgtcgggagcactataaattcccaaagaagaaaagaaaagaaaaaaaataaaaaacccaaattaaatgtcgagtaacgaagaaggagcctcggacacgggggcccccggccctggggtccccgtggcggacgtgtccgctgcggatggaagggccacttatgacgaccatggcatgtccacggactacgagaaacaaaccatcgaactgcccctgaacgggcagatacaatgcttatggtgccacattgaaggaaggaaccaaagattcctccaggaaagccaatacttaaaacacaaagacacgcaacaccctaaaggcgaaataatatggaggtgcgctgcatgccagaaagaattcgagaaactccatggctgcaggtgtcacttacccaagtgtaagggacgcaaagaagccaagggtgttgccaaatttaaatgcgactcctgcgaggaatcgttcctaacgcaaagaggattgtctatgcacgagctacatagacatccagcgattaggaacttgaaaagaacacaaggcaccagtcggggaaataccagaccaatcaacagagcctcggtctggtccaaagaggaaacggacctcttgataaaacttaacgagcgctacaaacacttaaaacagccgaacgtagcgctcaaagaatatttccccgacaagacactaaaacaaatcagcgacaaaagaaggctcttgcccgttcaggaacccgaagacgtggccacaactgatgaaacgggacctcctccttccgactcatcggaagagagcatatacgaatcggccacggaggacgaaggaggaggagatatgcaacaaacggctccaaacgatagctggaaggagccgtttatacaaagtataagaacaaaccacctcgaagaggaagactcccttcgaaaggtggaagaagccatcgaaagaatggctatgaatgaaggggtaactgaacaagaggtgggcacccttcttgaacaatttgtcgactccctaactcaatccccaacaacggaaagaaaggggagccgacgtaagagtcaaaagactacaaaaagaaagaccacccataacaatagaaaaaagttcttatatgccaaacaccaggagctctataaaaagagcccacgaaggcttctggagttggcgttatcgggtgagtctagcagtggcagagaagtggttaatctccctgaggccgactcagtgggtccactatataaaagtctatggggccaaataggcccggaaaaaactcacagaaaccaacctatgtgcaacaatatcgatatgagcgaaatttggactccaatcgccctggagagccttgtcgaaaaattcaaaaagataaagtccgacaccgcagccggcgcggaccagataaagaaattccacctgagaaagaaaggggcactacacgtattcgccaaactgtgtaacctcctcatgctgcaccgaatatacccagcacagtggaaaaccaaccgaaccacgcttattcccaaaccggggaagagcgcggaagaggttgagaactggagaccaatcaccatcgggtctctgctgggaagaatatattcggctatgatcgaccgtaaattacggtcgaaaataaagcagcacataagacagaaggggtttacacaggaggatggctgtaaaaataatatagccattctcagtagtgccttaaccaaaatgaaagaggactcaggtggaatcataaccataatagacatttccaaagccttcgacacggttccccacggcgaaataagccaaagtctgatgaacaaaggagtcccatcgcccatatgcgaatacattcaaaaaatgtacataggttgtaaaactattatatattgcagagacaagaaaacactgccagtggacatactgagaggagtcaaacagggagacccgctatcgccactgcttttcaacttgataatagatcccataatagggacactggacgagacgacggagggcattaaattagaaaacgagaacatttcagttctcgccttcgccgacgaccttgtccttttggcgaaagacaaagaaacagccgataagcaaaatcggctcatcaatgaatatctggacgacctgaaaatgaaagtatccgccgaaaaatgcacaaccttcgaaatcaaacggcagaacaaaacgtggttcctaggagacccacagttgacgttgggtcagcaacgtatcccgtatgccgacccagaagcagcaatcaaatacctaggaaccaacttcaatccatggagagggttgtgcaaaacctcgataaaagaaatcatcgatgcggctagaactgtcaaacagctgaaacttaagccgcatcaaaaaatcaaccttataagaacctacctcttgccaagatacatacataaattggtggcaaatcctccccctctggggactctagacctaatcgataaagagctcaaaactataataaaggaaatattgcacctccatccgtccaccacggacggactaatatacactgataagagccatggcggtctagggatccagcgggtggcgaacatagtcaagctggccaaactaaaacatagtatactaatgacaaggtcagaggataatgccgtcaagatagcacttaacgggcaagagggaatggtgaaaagatacgccacgtccataggcctacaatggccatgtggaatagaagaaatcgaggaaacgcgtaaaaaactcaagagggcggatacaaacaaatggaaaactttaatttcgcaaggacaaggcataaaagaatttttcggggataaaaccgggaatgcctggttatacaaccccgaaatgctgagaccgtctcgatacctggacgcactaaaactgagaacaaatacatatggcacaaaagcagcactccacagagcgaaaagagacatagacataaactgtcggagatgcggcgtccaggtggaaaccctaggacatatattgggactatgcacccatacaaagaacaaaagaataaaaagacacgacgaaatctgcgatcttatcgcaaagaatgtctctaaagaatacgtgatatttagggaaccagaagtagaggtaaacggtgacagacgtaaaccagatatggtcataaaagaccatgacaaggtatacgtcgtggacgtcaccgtaagatacgaaaacaatgattccctaaacaaggcctacaaagaaaaagaaaacaaatacaaagagacagcggaaattatgagaagagacttgaaagcaaaagagagcagagttctgccagtggttatcgggagcagaggggcagtgccccgagccactatagaaaatctaaaagtcctagggcttcaaacaaaacatgccctgacggcttcgctcatagccctccgatcgtcgatcgaaatggcaaatgaattcctggactacgatcacactacgtgatcgttaaaagtaaaaatctatttatttatttttattcctatattataacacattatttatttatttacttattgttttaaagatgacgaagccgcaaggccaatccaaatttaacaaaagaacgagactactggtcgacattaaaaagacgaagcagctgccagctgataaacaacagagcccgtctcggcctttacaccgagcggtgcaagtcctgacgtactattgtacgtctagggcgcggggcagattctaccgtgtagaatctggggcgacgcctccgcgaggcactccctggacaacgtacgctaaagcgtacggctaagtgcgcctcccgaaagggtccccgttcctaatttttccgagcccgcgggcagatctcgtggcagtgacgctagaaagttaagtccgcggacatataaaattacagccttaaataatgaaccccacgaaggaggtatcctcgaaattccgccacgatccttctgatcgtaggcgcaaaaca

SEQ ID NO: 1106 - DNA, 5188 bp, Nasonia vitripennis
  modified_base (896)..(896): a, c, t, g, unknown or other
  modified_base (986)..(986): a, c, t, g, unknown or other
  modified_base (1192)..(1192): a, c, t, g, unknown or other
gactagactatgggttcagtcagtcccaaatagccgatcctggcgcgtccggcagtaatgccacgtatgagtcggttacccatctctaaacgcgtagaggtggggagctaaaggccaggcggtttacccgacgtcgaatttctccaggtctgtgtcagtcgacggaataaaggtactacaacatctactatctatcgggatcggaagacgccttacagcgttttccgatttttgctctttgagcatttttcttcaaattgcgataaccgacccgatcacgcggggctttgacaaagcaatgcgtggtcggtaagatggttgcaatcttttccacctcgtttcttttacggaacgaaagcaatgcgtgtggggaacgttaaaaactcccttcatgcatcccaggatttatcctgcttactgcaaagcaatgcgtgtggagcgactttaccacgagtcgctccaccgcaaagcaatgcgtatcgcgcaaaagcaatgcgtgtgggggacttgtcaaagatcccccgccgcaaagcaatgcgtgtcggcaccacgtagagcaaagcgtgtaggcagactttgtcaaaagtagttctgccgcaaagcaatgcgtgtggagatcttcgccggtgaaagcaatacgtgtgggcgaacttagaccttcgcgcccacacatcccatggtgaggagcggcccatgtcgaaagactaagcgccccggtagtgactaccgtgaaagtctaataatggacagcggaaataacgttgcctcggagccgaggggagctgtggatgtgacctcagcagctccaatcggggcggagttaaacgccgaaccttgcgaaggtcgcaaccaaaggagggaggctgccttaagtgctcaaacacgccggcgaaatncggcccgccgagctcggaatgcccaacaggctgacgagcccggcgatgatgaggaaatagagacacacgggcctctaactatccggacgncggagccgatggagattgtcgcaatagcgaaaaacccacaggcctgtcccaaatgcctgcagggaggtacccaacttctctgcatgggcagctgggaactaagcaggcacattaataaagaacatccgtcagtcgacgtgacctgggtgtgcggtgcttgtcaaaggcgctgcacaacgctcaggtcgtggagctgtcatgttctncactgtaaggggcgacaagaaccaaaggatctgccgttcaaatgtgagcattgcagcttgtcgtttgactcgcaaatcggactctctcagcacgagaggcatgtccatccagaggtgcgaaacgataagcgcgcggcagaggccaataagccaaagggcaagagtggccgtaggccttctatatggtccgacgaagacttgctgctcatccgggaattagagagcgaataccacggagctcgaaatatcaatgaaaaaatagctgaacatttcccggatagaacaggcagacaggtgtcggacgcccggaggcgtaaggattatgccgcgctccgagggagaggaggcccgcaaggcccagcagaaggagtcgaggccatcgaagaggtagacgaaggcgaaatccctgagggggaagagctggtcgccaccgatggcgctgcgttggaaagcggccccccggagaatggagggagcgcacccgcagaacaagtcaatgcgcccgcgctggaaagcagttctcagcaagatcgagagtgcagcccggcagtggggtccgatgaacaaatcgaggacagcagtgacgacgacgaattcagcgacgcattaggagaaatatcactcccagaacctctctcggttgaacgcacaacaatctcaccacctcctcgagatgactggaaaggcccaatgaggtgggagatttgcaatgcgagcgaagaagccggaagttacgcgaactgggtgactggactgcaggagctagtcaggaacaatgcgctgagtgaaataggactagactccctgtatgaccagctcatccagattatgcggcacccttccgatgacaacgaacaggatcgccttcaattgaacgctagaggccccccacgaaggggccaccgcaagaaccgacggcgccgtcgtctcacggccgctgatcgaaagcggtttgcctttgccaggtgccaagatctttggaacaacaacccaaagaagctagccgagttagtgattgccaatgacctgtccattctccaaaggcgccaagcgccaggtagaacggagacacagactctgtacaacgagctgtgggggagggtcggacctaatatcgaagcgccaaggcgcaccgaagacccgatacccgtatcgaggatcttcactccgatcactccccaagagataatgggcagaatcaggcgaatcaaaaacgactcggcagcgggtcctgacggggtaacgaaggacgacctgagaggaagaggagtcagcatagccctctccaagctgttcaactcgatcctgctagcgggttactacccaaaggcatggagagagaacagaacaacccttctgccgaagccagaaaaagatcctgctgacgttaagaactggcggcccattaccatcagctcaatggttagtcgagtctactcaggcttgcttgaccagcgagtgagggccgtcattaagcagtgtgatcggcagaaaggattcacggaggaaaatggctgtttcagcaacatacagttgttggatgacgccgtatcgaacgcaaagaaagcgggcggtgtcattactatcttggatgtttcgaaagcattcgacactgtcccgcatgccgtgatccaagggtgcttggagaaaaaaggaatccccgaaaccgtggccgcctatatctcgagcatgtatcgcgactgctccactgcaatccgaacgaggagcggggacgtaaagattggaatgaagagaggagtcaagcagggggatcccctgtcacctctcattttcaatctggttctcgaacctctattagaacgattgcaagagacaagtggagtggaaatcgaaggcatgaatctctcgtgcgcggctttcgcagacgacatagtatgttttgcgaatacagcccccgaggcgggaaggcagctacggatggtggcggattatctgggccgactcgatatgagtctttcagtgtcaaagtgtatagctgtagagtatgtcccccacaggaagacctggtacactaaaaacccaggcctcgaggtgaacggtaatgccgttccgagcatctcacctagtgagacgttcaagtacctcggggcaaaggtctctccctggaaggggctgctcgaaggcttcgaatctgacgcgttcagggaagtcatatcccgcgtccaaagactgccgttgaagcccatgcaaaaggtggaccttctacagatgtatatctttccgaggtacacctatgggttgataacatcgcctccggcgaaggcagtcttaaagactatcgaccggatcataagaacgagaatcaaggagatcctccacctgccagaatcggtaagtagcagttttctctacacgccgaggaagcagggtggattggggctccttgaagtggagaagatggtgctgatagccgctcttcggaacggcttgagagcccgtcaatcccacgatccggtcacacgcgcggccatgaactcgaacgcagccgacgatcggctaaaatcttacgccgatgctctaagactacactggccactaacaaccaaggagctagatacttataagtatcagcttcgcctgagctatgcccagaaatgggctgagcaaaaatggcaaggccagggggtcgaggagttcgcacaagatcccgtcggcaactcatggctgcagcgctatgatcttctgcccgcgtcaaggtacatcgatgctatcaagctacgaacaaacacgtacccgacgcgagcactaatgaagatcatagatggacgtgttgatagctcttgccgaaagtgccaaggcagtagcgagacccttggtcatatacttggcagatgccggtatactaaggataagcgaataagccggcacaatgaaatcaaagacctcctcaaggctcgtctagccaaaaaccatcaggttatggacgagccgcagataacggtccgaggccagaggtttaaacccgatctcgtcgtgaaaacgaatgagggaagggtgcacgtaatcgacgtaactgtccgctacgagcacagaacctatctggatgagggccgtactgagaaaattggcaaatatcgccaaattctcagcacgcttcggcgagatctgcactcgaacgccgaggaggtcattccaattgtaatcgggtcgagaggtgcaattccaagggaaacgcggaaagccctctcgaaactcggaattggcaagagtgattggcttacgatctcactaatagcgctgcgtagctcgctagagatcgtcaacgccttcatggatgactgacctgaacaaaacgtgttgtcttgtcttgtctaaaactatttattcgaaataaggggaggctaactgcctgcaagttgaacgcgaaagttagaccttcccacctaaagcccaaaagtgatcggggaatgaatccgcgggtgaccccagagttgggtaaacccttgaaacgttggagaagcggaagagagtcccgccaccgagcatcgagtgctgcggcgcccgaatgaaaccgatcgcggatggtgcaagtcgtaggacggggcacgacctaagcctctgtcacggcggcgaagccaggaatcaccatgcaaaggtgtgaactggggcggatacctccacggggtttccctgggcatcgcgcgagcgatggccaaagtccgctttctcagctacaaaacaaaaatggtatgagacttcgttaacactaatttttccgagcctagcaggctcccttgacaacgcttatgaatctggaaaaggacacaaagtggaaaaagcgctgatggtggacaaaagtcagttgagacttgatatcagttgttttgactaagaattttattatcgttgacttttaaatattttattattgactgttaatatactgacttgggaccaagtcatctctgttacccggtaccggttcctgtcatcaaaccggaaagtccgtcccacgtaatgtggtagacgcaggag

SEQ ID NO: 1107 - DNA, 3720 bp, Ciona intestinalis; identical to SEQ ID NO: 385

SEQ ID NO: 1108 - DNA, 3646 bp, Nasonia giraulti
cgggttcccccgacttcggcttgccgtggtctggggctcactgctttttgtggagtcatggttacatggtgaccctggttcctcgcacccccgctggaaactatctggggaggccatgattgggtaacgataaaggtcctggtcgtgtcctcctgagataggctgaatgggtcactaagtggcacctaatgggttaccagccctaggcggccgagatacgttggtccacagaaaaagaaagcctcggatggaaatgacggacgagccgctgctcgtgccgaaccaacgaatccgggcggaccagaccgcgctgacgacgacgaaggggatgttaaattctggtgtgaatttccaggttgtgatcgcttctttatgaccaggagcggtagaggcctccatcacaagaaaggccaccctgattggaatgatcagagaaacctggccggaaagcaacaccgaaaagagatatggtcggaggaagaacgtctcctgcttgccaaaaaagaggcggagcttgccatcagtggagctaggtttattaacgtagagttgcgtgattttacagcgcgctccctagacgctatcaagggccagcgaaagagacccgactataagatcttagtcgagaaatttgtcagggagttaagggttagaggcattcgtcaaggagtggcctcgcggagtcaacaagctcgcgcgatggcggtggcaggagctcctgcagcgacgtcctcgggggcaccacctgtcgcgactcaaccaccaccatcaggtcgcgtactaagatctcaggtcgttgaagcaccagcgatggagatccccgtggcagagtcggaaggtgactcctcgggggacgagctgtttgaggatgtcgagcccgtgcgattgtccgacctaccccctgacaggtttacgatatactttgctgggcttgaaatacccggcaccgaagatatatatgcccacaggctccataccatctgcctgatgacaacgtggcgaaccaaagaagaggtaagattagaacttggcctctttttgaaagatttgttcccgagtaagggcagtcaagaacgcccggagagaaccaacctgccggacccgagaaatcggatcgagaggcggaggggggagtacaaaaaatgccaggatctatggcgacgaaataagtcaacctgtgttcagcggatccttaaagaggatctttcgcagggtgaatgtttgcctcgagagctgatggagcccttttggaatgcgactttcacccagaatcctggcacggctccggtgctccctcctcccacggaggtttattctagtgtttgggagcccattcggcccgagaatatcaagggcaactatccgccgcagaacaccgcggcagggatagacggactgacagtgggtgacctgaaaggggtgtcgcgggagatgctggccagaatttttaacttattcatgtggtgcggcaaactgccagagcacctttgtgcctcacgcacaattctcctgcccaagaaacctggggcgaaagtccccggcgaattcaggcctatcaccgtgacatccgtcctcatccggacctttcacaaggttctggccgaaagactgaaggttgtccctcttgacccccgccaaagaggcttcagagagtccgatggatgtgcagagaacgtgatgctactggacatgaccatccggtaccaccacgagcggcgcagaaagatgttcttggccctgctagacatggctaaggcatttgactcggtctctttcgagtccatgcgggaggttttgactactaaaggcataccaacgccatttattgagtattttatgacgcacttggaggatagttttactgttcttcagcatggtaactggcaatcggggaaaatccacccaacatgtggtgtgaagcaaggcgatccactgtctccgcctatcttcaacttcatcatggatgaaatgttgaagaggttgcctaaggaaatcggggttaacttggacgggttatttgttaatgctatggcatttgcggatgacctgagccttgttgccaataccgaacaaggtctgcagatcctcatagatgaagctacttcctttctggggctctgtggactccgcgccaatcccaataagtgcgtcaccctagcaattaagaccatcccgaaggagaaaaagacggccattgacccctcatcacattttaggataggtaatgcggtgatcccctcgttgaagaggacagatgagtgggtgtacttagggatcaaatttaattcaaatggtcgccttatctctgacgcaaaacccaagctcataaaagatcttgagctactaactaaggcaccactcaaaccacagcaaagactgtgggcgcttaaggtgattgtcattccgggcatcctttacagaggtaccctggggagcagcaccgcaggctacctacgctctcttgactgtgtaataagggcctatgttcggcgatggctacgtctccctggagattgcccgaatgggtattttcatgcagcggttgcggatggagggctgggagttcaccccatacgatacaaggcgatggtagatcgccttgcccggctccgaaaattagagaaatccgcgtacatcacggggcctgaagccgcacgttatcttcaaagacaagtttctatcgccgaaaataggctccgagatggggccaaccgcattatgagtgatgcgagtatgctaagggagttccttcgggagcttctgtacaagtcctttgatggtcgtcccctggaaaattccagcaaagtaccaggtcagcaccgctgggtcgaggagccaacccgtttcctatccggggcggactatatgaattgtatacgtgcgaggatcgcagctcttccgactgcagccaggtgtgctaggggacgtctcaaagacaagcattgccgggcaggttgcggaaatgtggagacgcttaaccacgtcttgcaattctgccaccgtacccatggcactcgcattggacgccatgatgcggttgtaaagtatgttgtaggaggactcaagaagagggggtacgcagtgaaagaagagccgaaaatcgtcttacaggatgtggtgtacaaacctgatatggttgcgaccaaggaagggaaaacactcattctggacgctcaggttctaggcgaccagcgtgatatgagactggcacatgaagataagctccgtaagtatggggccccagaatttaaacgaaagatcaggagtgagacggggtcggcaaccattaagtccttgtcggttacattgagctggcgagggttgtggggacctgactcagtaaaggggctcctcgaagagggagtgattctaaagaaggaccttaagatcttgtccacaagagtacttataggagctttggcaggctggagaaggtttaatgaaaggacgagtatggcaacatctggaagaagagaagaggttacaacaaggatggtgagaaggtggaagagaagagagagggtcggtgttggttagcggactggactgtctggaggagtgtttaactcgggttctcatgggaacccgacaacgttgttatcttgtatgacaattcataaaaaaaaaaaaaaaaaaaaaaaaaaaa

SEQ ID NO: 1109 - DNA, 3549 bp, Lepidurus arcticus
  modified_base (2424)..(2424): a, c, t, g, unknown or other
ggggtagcaattgatcgattcccgcttcctcgtggcgctaccctgggtaatactatgaggaattgatcacaccgtagcgaacgtcatcagtcacagctgcacgaatccagatagaaatataacagacgagtaattcttttaaaagctcgtcagtaatcttcccagatgtctggaaagagcagcaaaccgagaactgtatccagtggatccagttcccaagagactcctccaagtgggtccaacgcatgtgatatatgcgggaaatgcttcatgaaaccggtcggtttgtccagagtccatcctagtcaatatcatgcacgcttagaaaagaaccaacctaaagcgaagaagttcagatggactgatgaggatttgtattttttagcgaaaaaagaagcggaacttttacacttgggcagcattaaatttgtgaataaagaactggcagaattctttccggagaaatctgtcgaccaaatcagaggccaaagacgttctgagacgtacaaacagcaagttttatctatccattctgaactgctcaagttgcagactgtagccgattctcctcccccatcgagaatcccggcgaaagaagtctccgcttggcttgacttttttctggcccttcccaaaaccaagaataaatttagtgaagacaagttagaccaactcatccgtaccgctcaagatggtactctcatcctggatgatctagatttatatcttagagaagttctagttcaacccactagtcagggagagaaacaagcgaagttgctcccaccccccaaatccagtagagagaaaagagaccgcgaatatgcccgtgcccagaatttatatcggaagaataagaccgcttgtgtgaacgccatccttgatggtaacaagaagtgcgaaaataaaatacctgacattgacgatttctggaagaccatatttgagtcccattctcccccagatgcagaaccggtgtgttatgtcgttgacgaggagccgacaaatatttggagttggatttcattttttgagatgaatcataactaccccgattcgtctacctcacccggtcctgatggcgtgactgctcgcatgctccgttccatcccagcacgtgtcctaaataaattgttaaaccttttactctttattgaagacttacctgcagtgttcaagtgccatcgtaccgtgttgataccgaaaatcgacaatccgacatcaccaggcgaatttcgtcccatcacgatttcctccatagttgttcggcagctgaacaaaatcatcgctgctcgcgtctcagagggcgttcccataaatcctcgccagaaggccttccggcaaattgatggatgcgctgagaatgttttccttttggatttcattcttcgtgacgcaaaaacgaaaattaagtccctttcgttggctactgtcgacattaagaaagcatttgatagtgtgtcacatcattccatcttccgagcgattagaggagcgagatgccctgagaatctagtgaattatatccagaacagctactcgggttgtacgacccaaatttctgttggcggctctatatcagcatcaaaaatcccgatgaaccgtggtgtcaaacaaggggacccactatctcctgtcctctttaatttagtgataaacgaaattattcgcaaactgccggcctcgattggatacccaatcaatagtgagctttcgataaactgtattgcttatgcggatgacctgatactagttacaaatactagagagggcctgaagctactactcggcctattgaatgaagagctccctaagcgaggattagaattgaatgcatctaagtgtttcggcttatccttaacagcactcgggaaattgaagaagactcacctgtgtaccagtgaccaactcgatttacatgggactctaattaagaatcttaccgctgaggaatcctgggtttatttgggtgttcctttctcacacattgggcgctctaagagcttcagtccagatcttgaagctcttttaaataaactccagaaatcgccgcttaaactgcaacaaaagctttttgctttgcgagtttatctaattcctagactgctccacggtttagtcctatcaagagtggccattggcgaattaaaaataatggataagttaattttgaaacacttacgcgtatggcttcgtttaccgaaagatacccctttgggatttttctactcaccggtgaaattgggcggtttggggattaaaaacttacgtacaaacgttttgaagtgcaggaaacaacgcattgagcgaatgctagtctcccctgatgatgtggtgcgcttggttgcagagtcggagattttcctgaaagagacggacaagttaaaggacctacttactattaacggaatgtgcctagattancggaatgtgcctagaacgggaaaaaataacaagttttggagtgaaaggctatatacgtcatttgatggtaaaacacttgcctatagcgagtactttactcaaggcggcggctggatccgtgaagataagatccttcaacctgcccatgttttcgctgaatgcatcaagttacgtattaatgctttacccactaaatctagagttgcacatggccgtccaactaaagatcgttcctgtcgtgccggatgtcttgacgttcaaaaagtgccaactatcgaaacaatcaatcatatagcacaagtttgtcctcggacgcatggtgcaagaataaaaagacacgatcggctcgttcaattcctttctctcaaccttaggaaaaatccaaaaagaaatgttttagtggagtacaatttccgtacagtcgctggtatccgtaaaccggatatcattgttattgaagatacccgtgcagttatccttgacgtccaagttgttggtgattcgtccaatttggagatggaatacctggagaaatccaggaaatattctaatgacgctaactttatcaatgcgcttcaaaaactttatccaacggtcactaacctaacttttcatgcagttaccttcaacaatagaggcctgattgccaaatccacagtggcggccctccggatgctcggcgtcccacctagatgcataatgatcctttgtgtgattagccttgagaagaccctggaagtctggaggatgtttaaccaatcaactgcttccgctcggaaatgataatcgctccatcctgcaactaattatgaatgcaaatctgttaagtgacattagtgatacttacctgatacttaccctggtatttatttgacctatacttaccctggtatctacctgacatatatttatctaaccacctacctatgatgactcccgcggaaactctcacttaccttattacccacttggtcttttattttctcgttccttattactttgttcctttggtgtagggttctctggtttttggaacggcttccttagccggaattttgtctgatgtatcttgcttgtgtccttgaaatatacgacccaggcttgcgtcatttaggctctgggaaa

SEQ ID NO: 1110 - DNA, 3611 bp, Lepidurus couesii
tttggggtagcaattgatcgattcccgcctcctcgtggcgctaccccgggatagcctcaaagaaatttgacggtaaagcaaagaggaattgatcacccaaggcagtacatcggccttcctgcaggagctctgataaagatattagtgagttattctgttgaagctcgctatttcattcccctgatgtcagaggaaagcagaccaaagcagacggcctccaagcgtggagccgccgtggagaagactatgatgagtgggacctacgtgtgtactttatgtggtaggagttttgagaagtcggtgggtttgtcactccacacgaaccggatgcaccctgaagcttacaataagctgaaggaggctaagaaacctgttttgaagaaggcgcgatggtcagaggaggaggttttccttctagcgcagaaggaagcggagctctcattcattggaggaattaagttcatgaacatcgagctgcataaaatttttccagagcgtgagttggagggaatcaaaggccaaagaaagaacccaacgtacaaagcgcaagtcgttagcttattagctgagatccgagagtctaaggccaatgattcctcttcatcttcctcatcctcctcctcttgtgattcggcctctttgggcattagcaattggcttgaatttctgctagctctcccgaagacctccaaccaattccaggaaggtaggctagataggctaatctctgatgccctgcggggtgttgatgtgctagaaaaccttgatgcttaccttctcgaggttttcgctaagcccatggcgcaaaatccttgtccaaagcccccaccccctgcgaagaacagtcgtgagagaagggatagagaatactctagagttcagaatttttataagaagaaccgttcagcgtgcattaattccattttagacgggaacacccggtctcaaaatgtgatacctggcttgacgaagttttggaccgagacgtttgagaagaactcgccacctgatgatgaagcccctgaccagttcgttgcggacgagcctagagacatgtataagtggataactttttatgagatgtctcaagattatcttgattcttccactgctcctggagtggatggtttctctgccaaacagctccggtccatgtctcccagggtgctaaataagatattgaaccttttacttcttagtgagaacttacctaattcgtttaagatgcataagacagttcttataccgaagattgatgatccaaagagtcctggggattttagaccgatcacgatttcccctgtccttgctcgcctccttaacaagattctcgctgctagattgagcaaactagtccccattagtcagcgtcaaaaggcttttttgcctgttgatggctgtggggagaatattttccttttggattatattcttcgtagctctaagaaaagtagtaaatcagtggcgatggcagttttggatgttaaaaaggcatttgatagtgtatcgcatcactccatccttagagcccttaatgaggccaagtgtcctattaactttattaacttcgtcaggaatagttatgatggatgcactaccaaacttacttgtgggggtacttcctttccggactcggtacgcatgaaccgaggagtgaaacagggagatcccctatcgcctgtgctctttaatttgatcattgatagtgcaattaggaagttacctgactctatcggctatgtgataagggatggcttaaagattaattgcctggcatacgctgatgacctgattttggtagcttcaagtcgtgctggccttaagaccttactgaatattgttgctgagcatctctcgctacgcgggttggatttgaatgctgctaaatgtcatggtctgtcaattatcgccagtggtaaggccaaaactacttacgttagtgctgcggattccctagatcttgacggtcaacctataaagaatttgggagtgctggacacgtggacctacctcgggattccattttcccatctgggtcgagctgagaaagtttctcctgatttgaccaacttacttaacaaacttcagaaagctcccctcaaactccagcagaagttatatgctgtacgtaactttgttatccctagagcactccatggcctcattctatcgaagacaaacctaaaagaattaaacacgcttgatagagcaattagagtttttctacgtaccttgctttacttacctaaagatacgccactgggatttttccattcccctatcaagtccggaggacttgggattacgtgttttagaacatctgtccttaagtgccggctacagagaatagcccgaatgcgtagttcctgtgatggagttatacaggcagtggcggaatctgatatcttcgctgatgaatatgccaagttgcgggaccttattaggataaacggcaatgtgctcgacacgaccgagagtattaagaggtattgggctcaacgtcttcactcttcggtagatggcaagactttggcctacatggattatttccctcagggtaatctttggatgtcagaggataaagtgagccagcgatcttacgtctttgctgactgtgtcaagttacggattaatgccatcccaactcgtgtccgtgtttctcgtggtcgacctaataaggaaatgtgctgtagagcgaaatgttttgattcccagagaatgccagcgtttgaatccttgaaccacataacgcaagtgtgtccgcgcactcatggctcgcgaatccagcggcatgataagatagccaagttcctttttaagaacctgaacaattgcccatctcgctcggttctgtatgaaccccattttgtgacggtcgatggcctgcggaagcctgacattatcatttacgatgatagccacatggtggttctcgatgtccaggtggtttccgactctgctaacctggagaaggaatttgagtgcaaggcgaagaaatatgccaatgatgttgcacttcgatctgcaatgctaattaaatacccattcattaagtcattttctttcgttgcagctacctacaacaaccgtggtctgatagctaaatcctctgtccaggtccttcgccagctgggtctctcgccgcgctccataatggtctccatcctcatctgccttgagggtactttggaaacatggcgcatcttcaatcagtctacaatgaatgcccattagtgcttgagtgatgcctatcctttctttgattaactcttaccatatacttaccagttcttacccgtacttaccctgtatacttacctgtgtgcgtacctgtgtacttgtcctttagccgccttgtgtttttaccattggtacttaccttgtgtggttgcccgatacttaccttgtatttgccttgtaattctgcatgatatttattgtgtaggttcctgatgcttacctgatttgtccccctcatcatctttagtttcgttctatttcactccattatggagttccgtttgttttttggtggaggtacagcaccctttaagctggaattgagtgagtttatgtactttggatggttgtaataaactacccggaggcat

SEQ ID NO: 1111 - DNA, 3597 bp, Lepidurus couesii
  modified_base (2463)..(2463): a, c, t, g, unknown or other
ttttggggtagcaattgatcgattcccgcctcctcgtggcgctaccctgggataacctcaaagaaatttgacggtaaagctaagaggaattgatcacaccgtgacgaatatcatcagtcacagctgcacgaatccagatagatatataacaggcgagtaattcttttcgaagctcgtcagtaatcttcccagatgtctggaaagagcagcaaaccgagaactgtatccagcggatccagttcccaagagactcctccaagtgggtccaacgcatgtgatatatgcgggaagtgcttcatgaaaccagttggtttatcactacacatgtccaaagtccatcctactcagtaccatgcacgcttggaaaagaatcaaccgaaagccaagaaatttagatggacggatgaagatttgtattttttagcgaagaaggaagctgaacttttacttttgggtggcattaagttcatgaacaaggaactggcagaattctttccggagaaatctgttgaccaaatcaaaggccaaagacgttccgagacatacaaacagcaagttgtatcaattcattctgaactgcttaagttgcaggctgtagctgattctcctccaccatcgagaattccagcgaaagaagtctcggcctggcttgatttccttctggcccttcccaaaaccaagaataaatttagtgaggacaagttagaccaacttatacgtaccgcgcaagaaggcactccggtcctaaacgatctagatttatatctaagagaagttctagttcagcccacaagacagggagagagacaggcgaagcctctcccaccacccaaatccagtcgagagaaaagagacagagaatatgctcgtgtccagaatttttatcgcaagaataaaaccgcatgtgtgaacgccatccttgatggaaataagaagtgcgaaaacaaaatacctgacattgacgaattctggaaggccatatttgaatctcaatctcctcctgatgcagaaccagtgagttacgttgtagacgaggaaccgaagaatatttggagttggatttcgttcttcgaaatgaatcgtaactaccctgatacgtcgacctcacccggtccagacggcgtgacggctcgtatgctccgttccatccctgcgcgtgtcctaaataaattgttaaacctattactctttattgaagacttacctgcagtgttcaagtgccatcgtaccgttctgatacctaaagttgacaatccagcattaccgggagaatttcggcctatcacgatttcttccataattgttcggcagctgaataaaatcatcgctgctcgcgtctcagagggcgttcccataaatcctcgtcagaaggcctttcggcaaatagatggatgtgctgagaatgttttccttttagatttcattcttcgtgacgcaaaaacgaaaattaagtccctttcgttggctactgtcgacattaagaaagcatttgacagtgtgtcacatcattccattttccgagcgattagaggagcgagatgccctgagaatttggtgaattatatccagaacagctattcgggttgtacgacccaaatttccgtaggcggctctatatctacaacaaaaatcctgatgaaccgtggtgtaaaacaaggggacccactatctcctgtcctctttaacttagtgataaacgaaattattcgcaagctgccggcctcgattggatatccaatcaatagtgagctctcgataaactgtattgcctatgcggatgacctgatactagttgcaaatactagagagggtctgaagctactactcaacctattgaatgaagagctccctaagcgaggattagaattgaatgcatctaagtgtttcggcttatccttaacagcactcgggaaattgaagaagactcacctgtgtaccagtgaccaactcgatttacatgggactctaattaagaatcttaccgctgaggaatcctgggtttatttgggtgttcctttctcacacattgggcgctctaagagcttcagtccagatcttgaagctcttttaaataaactccagaaatcgccgcttaaactgcaacaaaagctttttgctttgcgagtttatctaattcctagactgctccacggtttagtcctatcaagagtggccattggcgaattaaaaataatggataagttaattttgaaacacttacgcgtatggcttcgtttaccgaaagatacccctttgggatttttctactcaccggtgaaattgggcggtttggggattaaaaacttacgtacaaacgttttgaagtgcaggaaacaacgcattgagcgaatgctagtctcccctgatgatgtggtgcgcttggttgcagagtcggagattttcctgaaagagacggacaagttaaaggacctacttactattaacggaatgtgcctagattancggaatgtgcctagaacgggaaaaaataacaagttttggagtgaaaggctatatacgtcatttgatggtaaaacacttgcctatagcgagtactttactcaaggcggcggctggatccgtgaagataagatccttcaacctgcccatgttttcgctgaatgcatcaagttacgtattaatgctttacccactaaatctagagttgcacatggccgtccaactaaagatcgttcctgtcgtgccggatgtcttgacgttcaaaaagtgccagctatcgaaacaatcaatcatatagcacaagtttgtcctcggacgcatggtgcaagaataaaaagacacgatcggctcgttcaattcctttctctcaaccttaggaaaaatccaaaaagaaatgttttagtggagtacaatttccgtacagtcgctggtatccgtaaaccggatatcattgttattgaagatacccgtgcagctatccttgacgtccaagttgttggtgattcgtccaatttggagatggaatacctggagaaatccaggaaatattctaatgacgctactttatcaatgcgtatcaatgcgcttcaaaaactttatccaacggtcactagcctaacttttcatgcagttaccttcaacaatagaggcctgattgccaaatccacagtggcggccctccggatgctcggcgtcccacctagatgcataatgatcctttgtgtgattagccttgagaagaccctggaagtctggaggatgtttaaccaatcaactgcttccgctcggaaatgataatcgctccatcctgcaactaattatgaatgcaaatctgttaagtgacattagtgatacttacctgatacttaccctggtatttatttgacctatacttaccctggtatctacctgacatatatttatctaaccacctacctatgatgactcccgcggaaactctcacttaccttattacccacttggtcttttattttctcgttccttattactttgttcctttggtgtagggttctctggtttttggaacggcttccttagccggaattttgtctgatgtatcttgcttgtgtccttgaaatatacgacccaggcttgcgtcatttaggctctgggaaa

SEQ ID NO: 1112 - DNA, 3922 bp, Nematostella vectensis
ggttggggccttctcgtggcggagtcgtgagtaaggggtataggggtaagggacaccacggaccgagaacggttaccgctcaaggcgagtggtggaaggcataaaatcgtaacgccgccctccgacctgctcctgaaactaatgccaaccaactgactgtggggctaacctccccagagtcaggatgctgaggggtactgggaatatgaatgacaagagggacggatcggccactgctgatcctacctcagcgcttttgggggctgtcggtgatggcagcctggtatgcaatctgtgtggccttgcttgcaagtctcgtggggggctctcgattcatcgaaggagcaagcatgccacggtgtaccatgcggaaaggcagcccgctccgcgggctaaggcgagatggacgaatgatgaaatgatacttgtggccagaaaacaaatagcttcggaaaagagtaggtgtagcgcagtagttgaagggatgcgagaagcagttccacatagaacttttgacgccgtcaaaagtctcaaaaccaagaataggaactacacacggattctggagcagattcgcgctgaatgctccgaggaagaggtgattgaatcaggagtccttaaggataggacggagaacgtgtgtgtgcaaacaacatctaacgttcccggttcggcaggacgggcagcatcggtggagctagagggtaatatccaggtgggccatcaactcgcccaaaaaaccatggcaggcaataatagtaggaaacagcctgccaatcataccaactgggctgagttcaatattgaggagggaaatattaccctccgaaaaagcaaaagaaaggctaatggtatgcccgatgcgacccaccgccccggcccaccgactgtcgacagtcttaagcacccagtatgcttgttgcagggtgcagccgacaaaagggacgaaccgcacacagtggaacaattgtattataacattgaggaaggaatgcctcttgccgaagagcaacagtggtcagaaaagcttttcgatgcaatcgactcatctttgttgtctgtcgaggtcgagctggggagaatcgttcctggttgccccgacgaagagacccgacagctcattgatagagaattcttggattttatccattcctattcgagggaaaagccgccacaaagaggtctcgctaagtccaaaccaccacccaaaggaccaaagagcctcagacgccagcaatatcggcaactccagagattgtgggacaaaaaccgatccgcagcagccgaacaggccctaacaggtaaatggcaagaagttcggactgctgctggggtcccattatcgttgatggaggtcccgtggcgggagattttcgaaacaccatctacgacggacgtccgagagccggccccagctgggccggttctgtggcagcttctcagaccagtgactatcgcagaagtagaggacgcaatttcctccaagaaatcagctagcggtccagatggagtgccttgtgccgcccttcaaaccatgggcgccgcctccctagcagctcactttaacttgtggctgttggccggtactcagcccaaacgcctaacagaatgccgaacaatatttgtgcctaaggaggtaaatactcacctgcccctccatcataggccaatcactatcggctcggtggttgtaagactcttccaccagattctgggaaagccaatggaagcagtactgccattggggtcgggccagcgcggttttcgaaagggtgacggaatatgccagaacatctggctcctccatactctaatcagacgcagcactgatttgctgaggccactcaagctggtcttcttggatgtgaaaaaggccttcgattcggttagtcacgaatcccttttaattgcggcgaagcgtctcggagtgcccgggccgctcctaacgtacatcaatgaactgtactctcgttcggagacagtctttgaagttgggggcgagagcagtggctctgttaaagtatcccaaggggtaaagcaaggggatccattgagttcgacgctcttcaactgcgtcattgactgggcggtctcagatctcgacccccacataggcgtcttactaggggagtctcgagtctcctttctagcttacgctgatgacctggttctcctatcggagaccgaggctgcactgacaagccagctgaactcaattgaaaagagtctagcgcactgtggtctcaagctcagtacgggggacagtggtaaatctgcttcgctgaacatcgtgattgatggtaaagctaagcggtgggttgtaaaccctaccccgttcctacgtgcgtctggtggcgaaattcgatctctcgtcgcaaatgagacgtacaagtacttgggcattaacatcggagcccagggcgtgaaagctgctgaatacaatgcattcaaagaagcactcgataacttgtctcgagctccacttaagccgcagcagaggttattcctgctgaagacctatctgttgccgcaactacaccactcactggtattgtcaaggacaactggcaaactattgaacagcctcgatgctctcgtaagaaaagctgtacggggatggcttaaattgccacacgacactcatagggccttcttttatgctcaccaggccgacgggggactcaatgtcccaagtctgtaccatctaatacctctcctaaggaggagtaggtatgaacgcttgacgagggtcgaagaccctgagataagggaagtgtcccgaaccgactacttcaaaagagtcttgggtgccgcggcggcggccaccacggttgcagggcatcgaattgattccaaagtaacgttgcgcctagcttggcgcgaggccctttacgcttcagctgacgggcggggtctctcccaatgcccgttggtacccgaggttcactcctgggttaccgatgtttccggtcttcagaccggatcgcagtacatctctgctgttcgcttaaggggggccttgcttcccacggcggtaaggaaatcgaggggtcgcgggggtgttaactcgaattgcgactgttgcggtcgtggacaaccagagtttcttgggcacgttctccagacgtgtcctcggacctgggggtctcgcatcagtcgtcacaaccacgtcctctcccttatcgctaaagcgtgccgttcgcgaagatggcaggtgctggaagagccgatcatccagactcctgcgcagttgctcaagccagacttggtgatctggaaccatcaagcggcgtacgtcgttgacgttagcgtaccgggtgataacaccccgctcagtacgtgtcacaacaggaaagtcgcatattactctggtgagagcgttcgtgaatgggtgcgttccaagactgggcataatcctacagtgtcctctgtagtgattaactggcgcggtgccatggcaaaggagtcctaccgccttttgacgaaagaccttcgtctagcgaagaccctgcctcgtctgctggtactaagagttctggaaggcggccatggaatctggctcaatttccatcggtcgaccttcgccgtgggagtaacttgatggtgggttactcgcctctgtgtaacaggcaaatgaaagctgcgcaagcagtcgatgagccaaagccgcacagcccccgactggggtacagggcagccctgggctatgcccgaagtcttttgacaggtccaaacttcacccttgccgccagtagggcaccagggccaggtgcaggtgggcgctttgttctatttggtttcgcttaatttttgttaaatttttcccgtgcgcccaccctttttaacccttttaacaccaattttttttacaaccctctactcaataatccaaatgaataaaagcggcataacaggtgaacac

SEQ ID NO: 1113 - DNA, 4317 bp, Schistosoma mansoni
atgttttaatttatttttgaactactactgtctgagtgcttcttacaacctgaaggctcagaaactacccactttttgctgtttatccacaacaacagttgtgaatctattctccaaatattccttgtgcttttgtcaacattattctataccaactgtaccacctacttcttcatctcacgttttaattctggtctaattttctcatcattagtcacggagagggcctatgaacggtccgtgacgcgaaattcaatccacgaattcgtcctcttctgctagtggtccccgaaatacggttcctctggcctgtcagttgtgttaaaactatataataacgatgccggtctcaaccggcgcagaaactgacataacctcttctttgcctattcctgcatcctcaatcgtctcgccaaactacacactccctgattcctcttcaacctgccttatatgtttcgctatcttccccacccacaacatactcctctcccatgccactgcaatccaccatatttcttgtcctcctactccagtgcaagacggttctcagcagatgtcttgtgttctttgcgccgccgctttttcatctaacaggggactaacacaacacattcgccaccggcacatctccgaatataacgaactaatcagacaacgaattgcagtgcagccgacgtctcgcatatggtcaccattcgatgatgcttctctactatcaatcgctaaccatgaagcccatagattccccacgaagaatgacttataccaacacatcagcactgtattaacacgcaggacggcagaggccgtcaaacgccgactcctccacctacagtggtccagatcacccacagcgattactacctcttcgaataatcacacaaccacagacatccccaataccgaggcccgatatatttttccggtagacctagacgaacatccaccattgtctgatgccacaacccccgacgcatcgacacatccactcccagaactccttgtcatcttgacaccgcttccatccccgactagactacaaaacatatccgaatcacagacctcccatgaatccaataggaactcaatgcatacaccgccaacgtatgcctgcgattcggatgagtcactaggggttactccctcatcaactatcccctcatgcttccacagttatcgggaccccctagctgaacaaagaagcaaactcctgagggcatccgccagcctactacaaagcagttgtactcgcatacggtcctccagcctgctcgccttcctccaaaacgcatccacattaatggacgaggaacacgtgtccaccttcctcaatagtcatggagaattcgtcttccctagaacatggaccccatcccgacccaaacacccctcccacgccccagctaatgtttctaggaagaaaaggaggaaaatagagtacgcacacatccagacactcttccaccaccgtcccaaagatgccgccaacaccgttctagacggtcggtggagaaacccctatgtcgcaaaccattcaatgattccagacttcgactgcttctggacaacagtctttactaaaacaaattccccagacagccgggagattactccaatcatccctatgactccctctctcattgacccgatcctcccctctgacgtcacatgggcgctgaaagaaatgcatggcacggccggtgggattgatcgtctaacatcgtacgatctgatgagattcgggaagaatggtcttgctggatatctcaacatgctactcgctcttgcataccttcccactaatctctcaacagcacgggtaactttcgtccccaagtcatcaagtcctgtgtcacctgaggacttccgtcccatcagtgtcgctccagtagccactaggtgcctgcacaaaattctagcaaagagatggatgccgctctttccacaggaacgacttcagttcgctttcctaaaccgagatggatgctttgaagcagttaatcttctgcactcggtcatacggcacgtccacacccgccatgcaggagcatccttcgccctgctcgacatatcacgggcctttgacactgtatcacatgactccatcatcagagcggcgaaaagatatggggcacctgaactgttatgccgctacctcaataactattaccgacgttcaaccagctgcgtcaaccgcactgaattgcatcctacgtgtggggtgaagcaaggagaccccctgtcgccactcctcttcatcatggttctcgacgaattactggaaggtctagatccaatgacccacctaacagttgatggagagagcttgaactacatagcttatgctgacgatctcgtagttttcgctccaaatgcagaactccttcaacggaaactcgatcggatctccctacttctacacgaggctggatggtcgattaaccctgaaaaaagccggaccctggacctaatctctggtggccattccaaaatcacagcgctctctcagacagaattcaccatcgcggggatgcgtataccaccgctttccgccgccgacaccttcgactatctgggtatcaaatccaacttcaagggccgatgcccagtggcccatattgacttattgaacaactacctcacggaaatatcgtgcgctccacttaagccgcagcagcgcatgaagatcttgaaagataatctactccctcgactcctctaccccctgactctaggaatagtacacctgaaaaccctgaagtcaatggaccgaaatatccacacggccataaggaaatggttgcggctaccctccgacaccccgctagcatattttcactcacccgtcgctgccggaggcctagggatcctccatctgtcctcatcggttccattccaccgtcgaaaacgtctagaaaccctcctatcttcaccgaaccgcctactgcacaagttgccaacttccccaacactagcttcttattcacaccttagtcaactgccagttcgaattgggcacgagaccgtaacgtctagagaagaggcttccaacagctgggtgagacgattacattcgtcctgcgacgggaagggactactcctagcaccactaagcaccgagtcccatgcatggctgcgctacccccagtctatttttccaagtgtttacatcaacgccgttaaattacgaggtggcttactatccaccaaagtcaggagatctcgcggaggtagagtgacgaatggcctgaactgtcgaggcggttgcgcccatcatgaaacaatccaccacattctgcaacattgcgcgctcacccatgacatcagatgcaaacgccataacgaactatgcaaccttgtggcaaagaaactgcgtaggcaaaaaatccatttcttacaggagccctgcattcctctagaaaaaacttactgcaaacctgattttataattatacgtgattcaattgcttatgttctagacgtcactgtatcggacgacggaaacacccacgccagccgcctgttaaaaatatcaaaatacggcaatgagcgaaccgtcgcatcgatcaagcgattcctcacatccagtggatatatcattaccagtgttcgacaaacaccagtccttacattcagaggtattctggagagagcaagttcacaatccctacgacgcctatgtttttcgtcccgtgacctcggtgacctttgcctgagtgcgattcaaggctcaattaaaatatataatacctatatgagaggaacccaacggctgaacgaatagcccccttcactcttagacattcccccactgttgttgcttatcttcatgtttttgtgttaattgactgctctcttctgggttgatgtctgattgtctctctctctttccatattgcttgctctccccgcttacttccaatagttgtcatattatgtctttgtttacttgccatgtctaacgacaattactttatctaccttagttggtcctcttggtttggttgccttcatgtgttcatggcggaatctgatgtttataatgactattcctactaccaccattacaactattattattatcactattattaacattattattacttctacaattagtattatggctactcctttcagcacaccaataaaatctcaatcaaacatctcacttattaaactctctatttccccttcgttataaacttacaattcagtttaaccgaatatctctcttttacaaatcttaagtatgtaattttgtgccaagcccatttgggtctgtacaatttgatacttaaaaataaatgttat

SEQ ID NO: 1114 - DNA, 3583 bp, Triops cancriformis; identical to SEQ ID NO: 146

SEQ ID NO: 1115 - DNA, 3548 bp, Drosophila ananassae
agaatatggatttgattgtgcagagggggtgctataccgtaactcgtaagccatgcaatcagatcaagtcgactcaaaacctcctcgtggtattctctgggtgccagtatttactggtagctgatttgagcggcgaaaggatccttggggttaccggccccctggaaccttaaaacaaattggtgcaactgaaaataacgagcctcggaacctaaatcgttttgtaagaggagaatccacggcttccagcctggagagcacacaatttggaaccagtgcagaggttaaccttgcagggagggtgccctgtacgatatgtgaaatgacgttcagctccaagaggggtttgggcgttcacatgtcacatcggcacaaagacgatcttgatgcacaacgtcttcgtgtcgataaaaaggcaaggtggtcagaggaagaaaccttgatgatggcgagaaaggaggttgagcttgcagcaagtggtgtacgatttcttaataagaagctagcggagattttcacccaccgcagtgccgatgcgatatcttcgtatcggaagaggagtgagtacaaggcaaaactagagcagataagggggcaatccgttcccaccccagaagcagaagaaatcaacaccacacagcgccgccctagtaatagcgagcaaaaccgacgagtaccaagatcagaagggggaccaatcgcaccaaccgaacagacgaacaacgaaatccttagggtactacagggtctagcacctgtagtatgcttaccccggtggagagccgaggtcctgcaaaatatcgtagataatgcgcaggtctcgggacaggaaaccactctccaaagtttatccagttatctcatggaaatttttccgccacggaatgaaccgcacattctgacgaggccccgaacggagcctcgaaatatgagacaacgtagaaggcagcagtacgcgagggttcagcgtaactgggataaacatccggggcgatgcataaagtccctactggaggaagatgatgagtcggtgatgccaaaccaggaggtcatggagccatattggagacgggtaatgactcagcctagctcaagctcgataaaacgcgacatgtttaacatggagcattcactcgagagggtatggtccgctgtgaaccagcgcgatcttagggccacaaaagtcaaattatctagttctccaggcccggacgggatcactccaaaaactgccaggagtgtccccgaaggcattatgcttcgcataatgaacttgatcctctggtgcgggaatttgccgtactctatccgtctggcccgaaccatcttcattccgaagaaggcgacggcaaatcaaccgcaagactatcgtcctatttcagtcccctcggttatagttaggcaactaaatgccattttggcttcccggttgagcgcagccatcaactgggacacgcgtcagcgagggttcctacctaccgatgggtgtgctgataatacgacgattgttgatttagttttgagggaacatcataagcgatttaaatcgtgctacatcgggaccctcgatgttagtaaggcctttgatgctgtagctcacgaagcggtctacaacacattggcttcatatggtgccccgaaaggcttcatcaactacttacggaaggcgtacgagggcggcggcacaatgctcgctgggaacgggtgggtttcagaggcgttcattcctgcccgaggagtgaagcagggtgaccctctgtctcccatactattcaacttggtcattgaccggttgcttaggtccttacccagtgagattggtgccaaagtcggaaatgccatgacaaacgcagcagcattcgcagatgatatagtcctttttgcggaaactccgatggggcttcagaaattgttggacaccaccgtttgtttcctttcctcggtgggtctcacccttaatactgataaatgtttcacggtcagtattaaggggcaagccaaacaaaagtgtaccgtcgtcgaacggcgaagcttcttgattggcgggcgcgagtgtccttcattgaagcgtactgacgagtggaagtacttagggattaaattcactgcggaggggcgggcccggtacgatccagcagaggacctcggtccaaagctgttgagattgactcgggcccccctgaaaccacaacagaagttatttgcccttcggaccgtccttatcccacaactctatcacaagctgacccttgggagtgtgacgataggcgttctgaagaaatttgacaaattagttcgatataccgcacggaagtggttggggcttccggtggacgtaccagtttcttttttccatgccccccacaagagtgggggtctcgggttaccatctctaagatggacagcaccaatgcttcgactaaagcgattgagcaacataaaatggcctcacctcgagcgatccgaggtagccagctctttcgtggaggaagaaatgcggagggcccgggataggcttcaggctggaagtgaagaactgttaacccgttcgcaggtagattcgtacttggcaaatagattgcacatgtctgttgatggttgcgggctccgtgaagcagagcgttttgctccgcaacacgggtgggttagtcagcccacgcgtttgctaacaggaaaggaatatactgatggaatcaaactgcggataaatgccctaccctcaaggtctcgtactacgaggggaaggcacgaattggagagacggtgccgtgcaggatgtgatgctcccgaaacaacaaatcacatcttgcagcaatgctatagaactcacgggaggaggatagctcggcacaacggcgtagtaaattttctcaagcggggacttgagcgaagaggctgcgtcgttcatgttgaaccaagtctgcagggcgaaaccggactgaataaacctgacctggtggctatccgacaaaatcgcatttatgtgattgacactcagattgtgactgacggacattctctcgaccaagcgcaccagcgtaaggtcgggaagtacgatacaccggacatacggacgaatttgcggagatctttcggtgcctttgacattgagttccattccgccactgtgaactggaggggaatatggagtggtcaatcagtaaaacggttgatcgcttcagacctcctcagctctggtgatagcaatatcatcagtgtccgggtaatcagtggtggtctctggagctggcggcagttcatgtatctgtcggggtacactcgcgattggacttagccaatgcacgggttccagattaagcttgctgccgaagcataccatcaaaatcggcataaaattcgcttaataaaggaggtggttttagtacgtaggcgtcccgggacttgtctcgggatgaatcgtgcatgcgtataattgggatcgataacaaataccaactaagttattactaatatatcgaaatacataaatatcccgtccttacgtatctttgaagatttccatcctcagcgaacaaaaaaaaaaaaaa

SEQ ID NO: 1116 - DNA, 3607 bp, Drosophila melanogaster
ttggggatcatggggtatttgagagcagagggggagtattcttctgtaattcgtaagtcatatcatatgatgtgcggaaggggaattttactctgtaactcacaagtctctcctttactcaagtcgactcaaaacctcctcgtggtggtcccggtaatgctaaactcgtttagcagctaatttgagcggaaaaacttttccgatgggctggttccccagaggaaatttattcatattggaactacaagcacaaataacgagcctcggatacctttacacaatctgatgacgacccgaccctccgtggatatcttcccggaggaccaatatgaaccaaacgcagcggctactctatctagggttccctgcacagtatgtggccggtcctttaacagcaagagaggactcggtgttcacatgcgatctcggcacccagacgaacttgatgaagaacgtcgacgtgtcgatataaaggcaagatggagtgatgaagagaagtggatgatggcgagaaaggaggttgagctcacagcaaatggatgtaaacacataaacaagcaactagcggtgtattttgcaaaccgcagcgtcgaagccatcaaaaagctaagacagaggggcgattataaggagaaaatagagcagataagagggcaatcagctctcgccccggaagttgctaatctaaccataaggcgccgccctagtagaagtgagcaagaccaccaagtaacaacatcggaaacaactccaatcactcccttcgaacagtcgaacagggaaattttgcggacactacgcgggtatagccccgtagaatgccattccaaatggagagcccaagagttgcaaactatcattgatagggcacatctcgagggaaaggaaaccactctccaatgcttatcgctatatctcctgggaatttttccggcacagggtgtacgacacacactgacgagacctcctcggagacctcggaacaggagagaaagcagaaggcagcagtacgctgtcgtccagcgtaactgggataagcataaaggaagatgcatcaagtccttgctaaatggaactgatgagtcggtaatgccaagccaagaaataatggttccctactggagagaagtaatgactcagcctagcccaagctcttgcagtggagaagtgatacaaatggatcactcgcttgagagggtatggtctgctattacagagcaggaccttcgggcgtcaagagtctcattatcctcgtctccggggcctgacgggataactccaaaatctgccagggaggtgccgtcaggtattatgctgcgcataatgaacctaattctatggtgcggtaatctaccacactccatacgactggccagaaccgtcttcatcccgaagacggtgacggcgaagcgaccgcaagactttcgtccaatatcagtgccttcagtcctggtaagacagctaaatgcaatattggcaacccggttgaactcatcaatcaattgggacccgcgccagcggggcttcttaccaaccgacggatgcgccgataatgcgacgatagtcgacttagtcttgaggcatagccataagcactttagatcttgctacatcgcaaatttagatgtaagcaaggcatttgattctctatcacatgcatctatatacgacaccttacgtgcttatggtgcgccaaagggcttcgttgactacgtacagaacacgtacgagggcggtggtaccagtctcaatggggacggttggagttcagaggaattcgtccctgctagaggagtgaagcagggtgaccctttgtctcctattctatttaacttggtaatggacaggttacttagaaccttacccagcgaaattggtgccaaagtcggaaatgccattactaacgcggccgcgtttgcagatgatttggtactatttgcggaaactcggatggggcttcaagtattgttggacaagacgttggattttctatctatcgtcggcctcaaacttaatgccgacaaatgttttaccgttggcattaagggccagccgaaacagaagtgtaccgtgttagaggcacagagcttctacgtaggctcgagtgagattccatcactgaagcgcacggacgagtggaagtacttaggcatcaacttcactgcaaccgggagggttcgatgcaatccggccgaggacattggtccaaagctacaaagattgacaaaggcccccctcaaaccacaacagaggttgttcgcccttcggactgtccttatcccacagctctaccacaagttagcccttgggagtgtggcgataggcgtcctaagaaaaactgataaacttataagatattatgtgcgaagatggctaaatcttccgctggatgtgccgatagcatttgttcatgcacccccaaaaagtggaggtctcggaattccatcactaagatgggtagctccaatgttaaggctaagacgcttgagtaacattaaatggcctcacctcacgcaaaacgaggtagccagctctttcctcgaagccgaaaaacaacgggcccgagatagattattagctgaacaaaatgaactgttatcgcgtccggcaatagaaaaatattgggcgaacaagttgtacctctcagttgatggtagcggactccgtgaaggcggccattatggcccgcaacacgggtgggttagtcaacccacgcgtttattaacaggaaaggaatatatggacggtattcgtctgcggataaatgccctacccacaaagtctcgtactacaaggggaaggcacgaattggaacgacagtgtcgtgcaggatgtgatgctcccgaaacaacaaaccacataatgcaaaaatgctaccgctcgcatgggaggcgggtagctagacacaactgcgtagtaaatcgaatcaagcggggacttgaggagagaggctgcgtggtcattgttgaaccaagtctgcagtgcgaatccggccttaataaaccagacctggtggcactacgacaaaatcacattgatgtgatcgacacacaaattgtgacagacggacactctatggatgatgcgcaccagcgcaaaatcaatagatacgacagaccggacatacgaactgaattgcgtcgcagattcgaagccgcaggtgacattgaattccattctgccaccctgaactggagggggatctggagtggtcaatccgttaaaagattgatagcaaagggtctcctcagcaaatatgatagtcatatcattagcgtccaggttatgagaggcagtctcggttgttttaaacagttcatgtacctgagcgggttttcccgagattggacttagctaaatcgtttggttcaaaacatttgcttgctgtcttggcataacatcaataaaggcataaacatcgcaaaataatggttataattaaatggctatgaggatggttttagtacgtaggcgttgcggaacttcggttcatatagagcaatgaatcgtgcatgctaggaaaactgaccacacacagtgttggcagacctagtatctttcgaagatttccatacctccgcgatcaaaaaaaaaaaaaaaaaaaaaa

SEQ ID NO: 1117 - DNA, 3533 bp, Drosophila persimilis
aagatatggatctgaataatagcgtagaaggggagtcattccgtaattcgtaaatcgtaaaaatcagatcaagttgattcaagacctcctcgtggtatcttctggatgctattagactgaagttcttttggtctaatagtaactaacttgaacagcgaaacagtcctatggggttgccagccccttggacagttcagtttgattggcactaatatgcaaaatacaacgcctcggataataaacactaattcgttgacgaaccaaatccctacggtctctagcctaggggcccaatctgaacatagtgcacaggttaacccaaacagtggttaccaatgcacgatatgtgaatcgtctttccgtagcaaaagcggactaggcgttcacatgtcacgtcggcacaaggacgagtttgatcaacttcgtctgcgtaccgaccgtaaggcacaatggagtgaggaagagttgagtatgatggcaagaaaagagatcgagctcgcagcaaatggagaaagatatctaaataagaagctagcggaagtatttacgaaccgtagcgtcgacgctatcaagaaatgtcgacagagggagagatataagaccaaaatcgaacagctaaagggtcaagctgttcctctcccagaagcattagaatctgaaaccatacagcgccgccctagtatacgcgagcgagatctcctagtaacgccacctaacactctcggaaccactccaaccgaactgtcgaacagtgaaatcctggcagtactacaggggtacccacctgtagtatgcaatgaccaatggagagttgaggttttgcaatccatcgtagatggtgcgcaggcctcgggtaaggaaattactcttcagcgcttgtctacttaccttatggaagtatttccctcacagaatgaccgccccattcaaacgagacctccacggagacctcgtaataggagacaaggtaggagacagcagtacgccttaacacagcgtaactgggacaagcacaaaggtcgttgtataaaagccattttggatggaactgaggggacagcaactatgccaagtcaaggtatcatggggtcctattggagacaagtcatgacacaaacaagcccaacatatagtggtacgaacaccacgttccggacggaacacccacttgaaggggtttggtccccgataacactaggggacctaagggtacacagagtgtcattgacgaaatctccaggacctgatggaattactccaagaactgtcaggagtattccgtcaggagttatgcttcgcataatgaacctgatactttggtgcggaaagttgcctgtctccatccgacaggcacgaaccatcttcattccgaaggtggggaatgcttctcgaccgcaagactttcgtccaattacggtacaatctgttatggtaaggattttaaatgccattttggcttcccggttgacctcatcagtcgactgggatccgcgtcagcgaggtttccttccaaccgacggatgtgccgataatacgacgatagtcgacttaatcttaagggatcaccataaacgttgtaaatcactttatatcgcaactttagatataagcaaagcatttgactcggtgtctcatgcagcagttagcgccactctaactgcatatggtgcccctaaagaattcgttgactacgtacaaaattcgtacgaggtctgtggcacaacgctcaatggggacggatggagatcagaggaattcatacctgctcgaggtgtcagacagggtgacccgctatctcccataatattcaacttgatcatcgatcagttgcttaggtcctaccccaatgagattggtgccacaatcggtgatcacacaacaaacgcggccgcgttcgcagatgatattgtcttatttgcggaaactcgtttaggccttcaaacaatgctagacacgactgtcgattttctatcttcagtcgggcttacccttaactcggataaatgttttacagttggaataaaggggcaaccgaaacagaagtgtactgtggtcatcccagagaccttccgtatcggttcgcgctcgtgtcctgcattgaagcgcacagacgagtggaagtatttaggcataacattcactgcacaagggaggaccaggtacagtccagccgacgacctaggtccgaagctgttgaggctgacaaggtcccccctaaaaccacaacagaaattgttcgcactcagaacagttcttatcccacaactttaccataagctgaccctaggtagtgtgatgataggtgttctgagaaagtgtgacatactggtacgttcgaccgtaaggaagtggttagggcttcctctggacgtgtcaactgcattcttccatgctcctcatacttatgggggcctcggaatcccttcagttcgttgggtagcgccaatgctacgtatgaaaagattgagcaatattaagtgggcccacctcgcgcaatccgaggcggccagctcatttcttaccgacgaattgaataaggcccggggtagaactctggctggactgaatgagttgacatcgcgtacagagatcgaaacgtactgggcgaacaggttgtatatgtctgttgatggtcgcggcttacgtgaagcgggactttttcgtccccaacacggctgggtgtgtcagcccacgcgtttgctaacaggtcaagattaccgaaacagtatcaagctgcgaataaatgccctaccatcgaggtctcgtaccacgaggggcagaaatgaattggaacggcaatgtcgtgcaggttgtgatgctcccgaaacaacaaaccacatcctgcagaattgttaccgtacgcatgggaggcgggtagcaagacataactgtgtagtcaataaccttaagaggattcttgaggagaagggccacacagtacacgtcgaaccaagtttgcagctggaaacctcggtaagtaaaccagacctggtgtgtatccgtgacaatcacgcttgcgtgattgatgcgcagattataacggatggactgtttctcgacgatgtgcaccatcgcaaagttgagaaatataaaagaccggaagttatatctgcactgcggagagaattcggagtgtcgggcaacgtcgaagtcctatccgcgacgttaaactggcgtgggatctggagcaatcaatccgttagaagattgatagcaaagggtctcatctcatccggtgacagcaatgtcattagcgccagagtggtaacaggcggactatattgcttcagacagttcatgtatctcgcaggttacactcgagattggacttagcctatacactatgttggagagaagacgcttgctacctaggcaaaatgtgaaattaggtataaacatcgtggttgtaaaacttgaggtgggtttttagtacgtatgcgtgattacttcgtaatcatgaatcgtgcatgctagtggggtttggcctccactagtatctttgaagattttccttcctcagcgatcaaaaaaaa

SEQ ID NO: 1118 - DNA, 3557 bp, Drosophila pseudoobscura
caattggaaagatatgggtctgaataatagcgtagaaggggagtcattccgtaattcgtaaatcgtaaaaatcagatcaagttgattcaagacctcctcgtggtatcttctggatgctattagactgaagttcttttggtctaatagtaactaacttgaacagcgaaacagtcctatggggctgccagccccttggacagttcagtttgattggcactaatatgcaaaatacaacgcctcggataataaacactaattcgttgacgaaccaaatccctacggtctctagcctaggggcccaatctgaacatagtgcacaggttaacccaaacagtggttaccaatgcacgatatgtgaatcgtctttccgtagcaaaagcggactaggcgttcacatgtcacgtcggcacaaggacgagtttgatcaacttcgtctgcgtaccgaccgtaaggcacaatggagtgaggaagagttgagtatgatggcaagaaaagagatcgagctcgcagcaaatggagaaagatatctaaataagaagctagcggaagtatttacgaaccgtagcgtcgacgctatcaagaaatgtcgacagagggagagatataagaccaaaatcgaacagctaaagggtcaagctgttcctctcccagaagcattagaatctgaaaccatacagcgccgccctagtatacgcgagcgagatctcctagtaacgccacctaacactctcggaaccactccaaccgaactgtcgaacagggaaatcctggcagtactacaggggtacccacctgtagtatgcaatgaccaatggagagttgaggttttgcaatccatcgtagatggtgcgcaggcctcgggtaaggaaattactcttcagcgcttgtctacttaccttatggaagtatttccctcacagaatgaccgccccattcaaacgagacctccacggagacctcgtaataggagacaaggtaggagacagcagtacgccttaacacagcgtaactgggacaagcacaaaggtcgttgtataaaagccattttggatggaactgaggggacagcaactatgccaagtcaaggtatcatggggtcctattggagacaagtcatgacacaaacaagcccaacatatagtggtacgaacaccacgttccggacggaacacccacttgaaggggtttggtccccgataacactaggggacctaagggtacacagagtgtcattgacgaaatctccaggacctgatgggattactccaagaactgtcaggagtattccgtcaggagttatgcttcgcataatgaacctgatactttggtgcggaaagttgcctgtctccatccgacaggcacgaaccatcttcattccgaaggtggggaatgcttctcgaccgcaagactttcgtccaattacggtacaatctgttatggtaaggattttaaatgccattttggcttcccggttgacctcatcagtcgactgggatccgcgtcagcgaggtttccttccaaccgacggatgtgccgataatacgacgatagtcgacttaatcttaagggatcaccataaacgttgtaaatcactttatatcgcaactttagatataagcaaagcatttgactcggtgtctcatgcagcagttagcgccactctaactgcatatggtgcccctaaagaattcgttgactacgtacaaaattcgtacgaggtctgtggcacaacgctcaatggggacggatggagatcagaggaattcatacctgctcgaggtgtcagacagggtgacccgctatctcccataatattcaacttgatcatcgatcagttgcttaggtcctaccccaatgagattggtgccacaatcggtgatcacacaacaaacgcggccgcgttcgcagatgatattgtcttatttgcggaaactcgtttaggccttcaaacaatgctagacacgactgtcgattttctatcttcagtcgggcttacccttaactcggataaatgttttacagttggaataaaggggcaaccgaaacagaagtgtactgtggtcatcccagagaccttccgtatcggttcgcgctcgtgtcctgcattgaagcgcacagacgagtggaagtatttaggcataacattcactgcacaagggaggaccaggtacagtccagccgacgacctaggtccgaagctgttgaggctgacaaggtcccccctaaaaccacaacagaaattgttcgcactcagaacagttcttatcccacaactttaccataagctgaccctaggtagtgtgatgataggtgttctgaggaagtgtgacatactggtacgttcgaccgtaaggaagtggttagggcttcctctggacgtgtcaactgcattcttccatgctcctcatatttatgggggcctcggaatcccttcagttcgttgggtagcgccaatgctacgtatgaaaagattgagcaatattaagtgggcccacctcgcgcaatccgaggcggccagctcatttcttaccgacgaattgaataaggcccggggtagaactctggctggactgaatgagttgacatcgcgttcggagatcgaaacgtactgggcgaacaggttgtatatgtctgttgatggtcgcggcttacgtgaagcgggactttttcgtccccaacacggctgggtgtgtcagcccacgcgtttgctaacaggtcaagattaccgaaacggtatcaagctgcgaataaatgccctaccatcgaggtctcgtaccacgaggggcagaaatgaattggaacggcaatgtcgtgcaggttgtgatgctcccgaaacaacaaaccacatcctgcagaattgttaccgtacgcatgggaggcgggtagcaagacataactgtgtagtcaataaccttaagaggattcttgaggagaagggccacacagtacacgtcgaaccaagtttgcagctggaaacctcggtaagtaaaccagacctggtgtgtatccgtgacaatcacgcttgcgtgattgatgcgcagattataacggatggactgtttctcgacgatgtgcaccatcgcaaagttgagaaatataaaagaccggaagttatatctgcactgcggagagaattcggagtgtcgggcaacgtcgaagtcctatccgcgacgttaaactggcgtgggatctggagcaatcaatccgttagaagattgatagcaaagggtctcatctcatccggtgacagcaatgtcattagcgccagagtggtaacaggcggactatattgcttcagacagttcatgtatctcgcaggttacactcgagattggacttagcctatacactatgttggagagaagacgcttgctacctaggcataatgtgaaattaggtataaacatcgtggttgtaaaacttgaggtgggtttttagtacgtatgcgtgattacttcgtaatcatgaatcgtgcatgctagtggggtttggcctccactagtatctttgaagattttccttcctcagcgatcaaaaaaaaaaaaaaaaaaaaaaaa

SEQ ID NO: 1119 - DNA, 3595 bp, Drosophila sechellia
gggatcaggggtaattgcgagcagagggggagtatttttctgtaattcgtaagtcatatcatatggtgtgcggaaggggaattttactctgtaactcacaagtctctcctttactcaagtcgactcaaaacctcctcgtggtggtccccggtaatgctaaacttgtttagcagctaatttgagcggcaaaacttttccgatgggttggttccccagaggaaatttattcatattggaactacaaatagaaataacgagcctcggagcaatttacgcaatctgatgacgacccgaccctccgtggacatcttcccggaggaccaatatgaaccaaacgcagcggctactctatctagggtaccctgcacagtatgtggccggtcctttaacagcaagagaggactcggtgttcacatgcgatctcggcacccagacgaacttgatgaagaacgtcgacgtgtcgatataaaggcaagatggagtgaggaagagaagtggatgatggcgagaaaggaggttgagctcacagcaaatggacataaacacataaacaagcaactagcggtgtattttgcaaaccgcagcgtcgaagccatcaaaaagctaagacaaaggggcgattataaggagaaaatagagcagataagaaggcaatcagctctcgtcccggaagttgcaaatctaaccataaggcgccgccctagtagaagtgagcaaaaccaccaagtaacaacatcagaaacaactccaatcacacccttcgaacagtcgaacagggaaattttgcggacactgcgtgggtatagccccgtagaatgccattccaaatggagagcccaagagctacaaacgatcattgacagggcagagctcgagggaaaggaaaccactctccaatgcttatcgctatatctcctaggaatttttccggcacagggtgtacgtcacactctgacgagacctcctcggaggcctcgaaataggagagaaagcagaaggcagcagtatgctgtcgtccagcgtaactgggataagcataaaggaagatgcatcaagtccttgctaaatggaactgatgagtcggtaatgccaagccaagaagtaatggttccttactggagagaagtaatgactcagcctagcccaagctcttgcagtagagaagtgatacaaatggatcactcgcttgagagggtttggtctgctattacagagcacgaccttcgggcatcaagaatctcattatcttcatctccggggcctgacgggataactccaaaaacagccagggaggtgccgtcaggtattatgttgcgaataatgaacctaattctatggtgcggcaatctaccacactctatccgactggccagaaccgtcttcatcccgaagacggtgacggcgaagcgaccgcaagactttcgtccaatatcggtgccttcagtcctggtaagacagctaaatgcaatattggcaacccggttgaactcatcaatcaattgggacccgcgccagcggggcttcttacctaccgacggatgtgccgataacgcgacgatagttgacttagtcttgaggcatagccataagcactttagatcttgctacattgcaaatttagatgtaagcaaggcattcgattctttatcgcatgcatctatatatgacaccttacgtgcttatggtgcgccaaagggcttcgttgactacgtacagaatacgtacgagggtggcggtaccagtctcaatggggacggttggagttcagaggaattcgtccctgctagaggagtgaagcagggtgaccctttgtctcctattctatttaacttggtaatggacaggttacttagaaacctacccagcgaaattggtgccagagtcggaaatgccattactaacgcggccgcgtttgcagatgatttggtactatttgctgaaactcgaatgggacttcaagtattgttggacagaacgttggattttctatctctcgtcggcctcaaacttaatgccgacaaatgttttaccgttggcattaagggccagccgaaacagaagtgtaccgtgctagaggcacagagcttttacgtaggctcaagggagattccatcattgaagcgaacggacgagtggaagtacttaggcatcaacttcactgcaaccgggagggttcgatgcaatccggccgaggacattggtccgaagctacaaagattgacaaaggcccccctcaaaccacaacagaggatgttcgcccttaggactgtccttatcccacagctctatcacaagttagcccttgggagtgtggcgataggcatcctacgaaaaactgacaaactaatacgatactatgtgcgaagatggctaaatcttccgctggatataccgatagcattcattcacgcacccccaaaaagtggaggtctcggaattccatcacttagatgggtagctccaatgttaaggctaagacgtttgagtaatattaaatggcctcacctcacgcaaaacgaggtagccagctctttcctcgaagcagaaaaacaacgggcccgagatagattattagcagaacaaaatgaattgttatcgcgtccggcaatagaaaaatattgggcgaacaaattgtacctctcagttgatggtagcggactccgtgaagcaggccattggggcccgcaacacgggtgggttaatcaacccacgcgtttactaacaggaaaggaatatatagacggtattcgtctgcggataaatgccctacccacgaagtctcgtactacaaggggaaggcacgaattggaacgacagtgtcgtgcaggatgtgacgctcccgaaacaacaaaccatattatgcaaaaatgttaccgatcgcatgggaggcgcatagctagacacaactgcgtagtaaatcgaatcaagcggggacttgaggagagaggctgcgtagtcattgttgaaccaagtctgcagtgcgaatccggtcttaataaaccagacctggtggcactacgacaaaatcacattgatgtgatcgacatacaaattgtgacagacggacactctatggatgatgcacaccagcgcaaaatcaatagatacgacagaccggacatacgaactgagttgcgtcgcagattcgaagccgcaggtgacattgaattccattctgccaccctgaactggagggggatctggagtggtcaatccgttaaaagattgatagcgaagggtctcctcagcaaatatgatagtcatatcattagcgtccaggttatgagaggcagtctcggttgttttaaacagttcatgtacctgagcgggttttcccgagattggacttagctaaaacgtttggttcaaaacatttgcttgctgtcttggcataacatcaataaaggcataaacatcgcaaataatggtaatatataaattggctatgaggatggttttagtacgtaggcgttgcggaacttcggttcagatagagcaatgaatcgtgcatgctaggaaactgaagtgttgacagacctagtatctttcgatagatttccatacctccgcgatcaaaaaaaaaaaaaaaaaaaaa

SEQ ID NO: 1120 - DNA, 3607 bp, Drosophila simulans
gggatctggggtaattgcgagcagagggggagtatttttctgtaattcgtaagtcatatcatatggtgtgcggaaggggaattttactctgtaactcacaagtctctcctttactcaagtcgactcaaaacctcctcgtggtggtccccggtaatgctaaacttgtttagcagctaatttgagcggcaaaaacttttccgatgggctggttacccagaggaaatttactcatattggaactacgaacacaaataacgagcctcggatatctttacacaatctgatgacgacccgaccctccgtggatatcttcccggaggaccaatatgaaccaaacgcagcggctactctatctagggttccctgcacagtatgtggccggtcctttaacagcaagagaggactcggtgttcacatgcgatctcggcacccagacgaacttgatgaagaacgtcgacgtgtcgatataaaggcaaggtggagtgaggaagagaagtggatgatggcgagaaaggaggttgagctcacagcaaatggacataaacacatgaacaagcaactagcggtgtattttgcaaaccgcagcgtcgaagccatcaaaaagctaagacagaggggcgattataaggagaaaatagagcagataagagggcaatctgctctcgtcccggaagttgcaaatctaaccataaggcgccgccctagtagaagtgagcaaaaccaccaagtaacaacatcagaaacaactccaatcactcccttcgaacagtcgaacagggaaattttgcggacactgcgtgggtatagccccgtagaatgccattccaaatggagagcccaagagctacaaacgatcattgacagggcagagctcgagggaaaggaaaccactctccaatgcttatcgctatatctcctgggaatttttccggcacagggtgtacgacacacgctgacgagacctcctcggagacctcggaataggagagaaagcagaaggcagcagtatgctgtcgtccagcgtaactgggataagcataaaggaagatgcatcaagtccttgctaaatggaactgatgagtcggtaatgccaagccaagaagtaatggttccctactggagagaagtaatgactcagcctagcccaagctcttgcagtggagaagtgatacaaatggatcactcgcttgagagggtttggtctgctattacggagcatgaccttcgggcgtcaagaatctcattatcttcatctccggggcctgacgggataactccaaaatctgccagggaggtgccgtcaggtattatgttgcgaataatgaacctaattctatggtgcggtaatctaccacactctatccgactggccagaaccgtcttcatcccgaaaacggtgacggcgaagcgaccgcaagactttcgtccaatatcggtgccttcagtcctggtaagacagctaaatgccatattggcaacccggttgaactcatcaatcaattgggacccgcgccagcggggcttcttacctaccgacggatgtgccgataatgcgacgatagttgacttagtcttgaggcatagccataagcactttagatcttgctacatagctaatttagatgtaagcaaggcattcgattctttatcgcatgcatctatatatgacaccttacgtgcttatggtgcgccaaagggcttcgttgactacgtacagaatacgtacgagggtggcggtaccagtctcaatggggacggttggagttcagaggaattcgtccctgctagaggagtgaagcagggtgaccctttgtctcctattctatttaacttggtaatggacaggttacttagaaacctacccagcgaaattggtgccaaagtcggaaatgccattactaacgcggccgcgtttgcagatgatttggtactatttgctgaaactcgaatgggacttcaagtattgttggacaaaacgttggattttctatctctcgtcggcctcaaacttaatgccgacaaatgttttaccgttggcattaagggccagccgaaacagaagtgtaccgtgctagaggcacagagcttctacgtaggctcgagggagattccatcactgaagcgaacggacgagtggaagtacttaggcatcaacttcactgcaactgggagggttcgatgcaatccggccgaggacattggtccaaagctacaaagattgacaaaggcccccctcaaaccacaacagaggatgttcgcccttaggactgtccttatcccacagctctatcacaagttagcccttgggagtgtggcgataggcgtcctacgaaaaactgacaaattaataagatattatgtgcgaagatggctaaatcttccgctggatgtgccgatagcattcattcatgcacccccaaaaagtggaggtctcggaattccatcactaagatgggtagctccaatgttaaggctaagacgattgagtaatattaaatggcctcacctcacgcaaaacgaggtagccagctctttcctcgaagccgaaaaacaacgggcccgagatagattattagcagaacaaaatgaattgttatcgcgtccggcaatagaaaaatattgggcgaacaaattgtacctctcagttgatggcagcggactccgtgaagcgggccattggggaccgcaacacgggtgggttaatcaacccacgcgtttactaacaggaaaggaatatatagacggtattcgtctgcggataaatgccctacccacgaagtctcgtactacaaggggaaggcacgaattggaacgacagtgtcgtgcaggatgtgacgctcccgaaacaacaaaccacataatgcaaaaatgttaccgatcgcatgggaggcgcgtagctagacacaactgcgtagtaaatcgaatcaagcggggacttgaggagagaggctgcgtggtcattgttgaaccaagtctgcagtgcgaatccggccttaataaaccggacctggtggcactacgacaagatcacattgatgtgatcgacatacaaattgtgacagacggacactctatggatgatgcacaccagcgcaaaatcaatagatacgacagaccggacatacgaactgaattgcgtcgcagattcgaagccgcaggtgacattgaattccattctgccaccctgaactggagggggatctggagtggtcaatccgttaaaagattgatagcaaagggtctcctcagcaaatatgatagtcatatcattagcgtccaggttatgagaggcagtctcggttgttttaaacagttcatgtacctgagcgggttttcccgagattggacttagctaaaacgtttggttcaaaacatttgcttgctgtcttggcataacatcaataaaggcataaacatcgcaaaataatggttatatataaatggctatgaggatggttttagtacgtaggcgttgcggaacttcggttcagatagagcaatgaatcgtgcatgctaggaaaactgaccacacgcagtgttggcagccctagtatctttcgatagatttccatacctccgcgatcaaaaaaaaaaaaaaaaaaaaaaa

SEQ ID NO: 1121 - DNA, 3548 bp, Drosophila yakuba
gggaacatggggtaaaggtgagtagagggggagtattttttatactctgcaactcataagtcttgcctttactcaagtcgactcaaaacctcctcgtggtgtttcccggtaatgttaaacttgtttagcagctaatttgagcggcgaatctttccgaaagggttggttcccctgacgaaggataatcatattggtaccacaaatttacaaaacgagcctcggatatttactaatgatctgttgacgacccgaccctccgtggatcacgtcccggaggaccaatatgaaccaaacgcagcggctactctatcaagggttccctgcacagtatgtgaccggtcctttaacagtaagagaggactcggtgttcacatgcgatctcggcacccagacgaacttgatgaagaacgtcgacgtgtcgatataaaagcaaggtggagtgaggaagagaagtggatgatggcgagaaaggaggtcgagctcatggcaaatggttttaaacacataaacaagcaactagcggtgtattttgcaaaccgtagcgtcgaagccattaaaaagctgagacagaggggcgattataaggagaaaatagagcagataagagggcaatccgctctcgccccagaagttgctaatctaaccataaggcgccgccctagtagaagtgagcaagaccaccaagtaccaacgtcagaagcatctccaatcactccgctcgaacagtcgaacagggaaattttgcggacgctgcgtgggtatagccccgtagtatgcccttccaaatggagagcccaagaactacaaactatcattgatagggcggaatttgagggaaaggaaaccactctccaatgcttatcgctctacctccagggaatttttccggtacagggtgtacgacacacgctgacgaggcctcctcggagacctcggaataggagggaaagcagaaggcagcagtacgctgtcatccagcgaaactgggataagcataaaggaaggtgcattaagtccctgcttaatggaactgatgaatcggtaatgccaagccgagaatttatggagccctactggagagaagtaatgactcagcctagcccaagctcttgcaatggagaagtgattcgtacggatcactcgcttgagacggtatggtctgcaataacggaacaagaccttagggcatcaagagtttcattatcttcatctccggggcctgacggggtaactccaaaaactgccagggaggtgccgtcaggtattatgctacgcataatgaacctaattctatggtgcggtaacttacctcattctatccgactggccagaaccatcttcatcccgaagacggtgacggcaaagcgaccgcaagactttcgtccaatatcggtgccttccgtcctggtaagacagctaaatgccatcttggcaacccgattgacctcatcaatcgattgggacccgcgccagcggggcttctcaccaaccgacggttgcgccgataatgcgacgatagttgacttagtcctgaggcatagccataagtactttaaatcttgctacatcgccaacttagatgttagcaaggcatttgactcattgtcacatgcagcaatatatgggacattacgagcttatggtgcgccgaagggttttgttgactatgtacagaagacgtacgagggaggtggtatcagtctcaacggggaaggttggtgttcagaggaattcgtgcctgctagaggagtgaagcagggcgaccctttgtcccccattctatttaacttggtcatcgaccggttacttagagccctacctagcgagattggtaccaaggtcggaaatgccatgataaacgctgctgcatttgcagatgatttggtactatttgcggaaactcggatgggacttcaaactttgttggacaagactgtggactttttatccaccgtcggccttaaacttaatgctgataagtgctttactgtcggtattaagggacagccgaaacagaagtgtactgtgctagaggcacagagcttctgcgtaggctcgagagagattccaacactgaagcgtactgacgagtggaagtatctcggtatacatttcactgcaagtgggagggttcgatgcaatccggcagaggacattggtccaaagctacaaagattgtcagaggccccccttaagccacaacagaggttgttcgcccttcggactgtcctgatcccacaactctatcacaagttatcccttgggagtgtgacgataggcgtcttacgaaagactgacaagctaatacgtttctatgtgcgaagatggctaaatcttccgtcggatgtgccgatagcattcgttcatgcccccccaaaatgtgggggtctcggaattccatcactaagatgggtagcaccaatgttacgacttagacgattgagcaacataaaatggccccacctcgtacaatccgaggaagccagctccttcatcgaagcggaaaaacaaagggcccgaggtagattgatagctgaacaaaatgaattgttatcgcgtccggcaatagaaaagtattgggcgaacaggttgtacctctccgttgatggtggcggactccgtgaagcgggccactatggtccccaacacgggtgggttagtcagcccacgcgtttactaacaggaaaggaatatttagacggtattcggctgcggataaatgccctacccacaaagtctcgcactacgaggggaaggcacgaattggagaggcagtgtcgtgcaggatgtgatgctcccgaaacaacaaaccacattatgcaaaaatgctatcgttcgcatgggaggcgagtagctagacacaactgcgtagtaaatcgaatcaagcggggacttgaggagagaggctgcgtggtcattgccgaaccaagtctgcagtgcgaatccggccttaataaaccggacctggtggtactccgacaaaatcacattgatgtgattgacgtgcaggttgtgacagacggacattctatggacgaagcgcatcagcgcaaaatcaatagatacgacagaccggacatacgaactgaattgcgtcgccgattcgaagccgcaggtgacatcgagtttcattctgccaccctaaactggagggggatttggagtggtcaatccgtaaaacgattgattgcgaagggtctcctcagcaaatatgatagtcatatcattagcgtccaggttatgagaggcagtcttggctgttttagacagttcatgtaccttagcgggttttctcgtgattggacgtagcttaaaacgtttggttcacatacatctgcctgctgccttggcacaatatcaaaaaggcataaacatcgcacatattggttatttacggctatgaggatggttttagtacgtaggcgttgcggaacttcggttcggatagagcaatgaatcgtgcatgctaggaactgaccaaataacagcagccctagtatctttcgaagatttccatacctttgcgatcaaaaaaaaaaaaaaaaaaa

SEQ ID NO: 1122 - DNA, 4482 bp, Kalotermes flavicollis; identical to SEQ ID NO: 117

SEQ ID NO: 1123 - DNA, 5021 bp, Reticulitermes lucifugus; identical to SEQ ID NO: 147

SEQ ID NO: 1124 - DNA, 5020 bp, Reticulitermes urbis; identical to SEQ ID NO: 377

SEQ ID NO: 1125 - DNA, 4718 bp, Rhynchosciara americana; identical to SEQ ID NO: 150

SEQ ID NO: 1126 - DNA, 6550 bp, Ciona savignyi
  modified_base (3376)..(3376): a, c, t, g, unknown or other
  modified_base (3727)..(3727): a, c, t, g, unknown or other
  modified_base (4401)..(4401): a, c, t, g, unknown or other
  modified_base (6423)..(6423): a, c, t, g, unknown or other
  modified_base (6525)..(6525): a, c, t, g, unknown or other
ccaaaattacttccagcacctccacagcagacgaacgaagaaagaagacttacgaaataagaataagcagtttaaagacgaagcagacgaacaccactccaccaacgacgctctgcagctacaccaccaccatctcgccgcaacaagaagaattttccgctgctctccactctgctccaacaccacctctcctgctctgtggactgctgccttgctgctggaccaacctctacccgaaggaacccttcgaacccagcagcaaggtacgtgtcaccacctctccacagagccaaggccagagtggatagagcagcggcctctacaaccaagttctccactccgacgacaaaacacctgcctcgtggccagagtcctgccgaagaagaatcttcgaccccaacaccgtctcggcagggctccaagcaacgacatcagccacgagtgcccaccggagtggacgcggcgaacccgaggaccgctgtcgccaagaacaataacatcaccgcctgcagcagctaccaaacaaaggttagtctcctacctcacctacaaactcgtctgaatagacgcccccgcgtgggagctaaccttggtagctagctgcagtgccctgcgacagcggcctcgaagagctgcagagcgtcagcctgcttcgacctcgcttgttctcatttcaacctactccgtcctgtggaatcaaaagagccccactaacaattacattcataaaatctagcaagaacgaagagaagcgaccaacttttaatccataacttttagatctttttatttattactgtttttaagccctaagcatattgcctttttttagatcttataattataaaaatagattcaaagttaacaccaccaggccgctacagagcattttatttaatcaatttgttaccgacctcctgctgcttctttttactttctccagactactacccggatacaacccttggaaacgagaggaatggccggtcacaagatcacaatgtcggaggggaagctgctggaggttgctgtacggtatggtggtgtgaggaatgtctcgtacgagtgtccagtcccggattgcacaaaaaccttctcacaggcaaataacttgatacggcatttaaataactttggcaatacaaaacaccgagcacacaatttcacctattttttcacctgtgagaagtgcaaaatccaaattcacagcaacacaaaacataatatttcaaatcattacaaacagtgttgtgcaaccggcggcggaccctcgtgcgagacgggtcaatacttctgccctgcctgcgagcaagcagggctggggaacctggagtcggcactccgccattttcaatcctcccaccctgaatttaatctacccccccggtctcaattttcaaaatctcatcccaatagttataccctatccttaaaacctaaagaccaccttatgaaaatactttacagtggaccactgactccggggcaattggtatgccccattaagatctgtctcaggtcctcagctgcacgtcttttccatgacgtgtccaagctgaggaagcacatgttggttgatcacaaccgaacccttgtgtacgagacaacatgtggcaaatgcttgcggcctgtcgacacctcgaaaaatatgcggaaaacgacgtcgcacttcgaaaagtgttctggcgaatcctttatctcatccccctcacccataccccaaaagacttataaactcgacttaccctcaaccagcacccctcccccccgtaaatctcccaaattacaaccctacaaaccaattcgaacctttaagaaccccctcaccaagtccagtcaatccaaatccgacaacccacccaaacctaccccttttttctcgccaagaacacttgagaggtcggcgtcgtggcccgcattgagcgaggttgtcgacccactgcccaagctcaaggaaaaacacccctcgctgccatgcgccctggataagtgcccaccctcaccccggatcaaaccctcgaccctagtccctccctgccatacagcaaacaatagtcccaaaccaacttcacccgaatcaccctctaccctaaaacccttaccccgccccatccgaccatctaaacccttggaggattggttaactgtgcggagcgtgggaccggatcgggagatcgtcctgaacatcggtccgagaccccgacccggccccgcagcaggctccaggacaacatctcccccgtcaacggcacccgcgaaaagggttgctgcaaacccaatcgcagcacccttgagcggggagccgggtgcgacccttgattgcggccagaccgggcgaaaggttcagccgccaaaaaagagaccgacagagagtgctgggtccctccctcctccggccgagccagccaccgatctccttacagggagagaggggctggcgaggctggttgaggaatatcatctgtcgggggactttggcgctttctgtcgggatctcgagcgatggacggcgctttcgtcgaccaaccgaaggccaaagccgaggcgcggcaggtacaaccgcggtgcggctgcccgtgccaccaggaaccggggccgagatgatcgtcaagatccacaagatcgagacgatcaaggaggccccggtccggtgacatgcgggcggccgcaaagatacaagcgggccgccgcgctgaggtcggccttcgggagggacatgaaggcgaccgtccgtcgcatcatagacggagaacggggcgacgctcgctgtgaaatcgaccccaaaaccatcgagggtcgatttcgcgacgagctgtcgccgccggttcgggaagggccggagtgctcgttgcccccttggatggctgaagcccaggcaggtgagcatgcgccatcgaatgatagccaacccggcgatgcatacgatgggccaatcacggcgctggaggtggagatggtcctcagtaccctgaacgtcggctctgccccgggatcggacggcctctcctatggattttggagagctctagacccgaaaggactcgtcctttcggagctcttcgaagtctgtaggatcgagcgccgggtcccggggccatggaagagcagccgggtcaccctcatctgcaaagatgcagagggtgacctcgacgatttggggaactggcggcccatctccatctgccagacggtgtataagatctacgccgccgtgttggcccgtcgactgcagagctgggcgcttgacggtggcgtcatctcccgaagtcaaaagggcttcatgccgttcgagggggtatacgagcatgtattcctcctcgactcggtcgtcgctgacgcgcgcgcgacccggaggtcgctggccgtgtgctggctngacctccggaacgcgttcggcagcgtcgaccacaccaccatagtcgaggcgttgtctcgcttcggcgcccccgcgggcctcgtggagatgatatcggacatctatacgggtgggtcctgccgaattagaactcgtgcgggattcaccccggacatccctgtcggtcgtggagtgcgacaggggtgtcccttgtccggtatcatcttcaacctcgtgatggaggtcctgctgcggggcgtcgaagcgaacaacgcttgtggataccggctctcctgcgccggcggcgcgtccgtcagggtgctcgcgtacgccgacgatgtggctctggtgggctcttccagggccgagatnaagatccagctgggtgtgtgcgagcggtttgccgcctgggccggtttttcttttaacaacaagaagtgcgccgccatggtactgaaacatcagagagggggtcggaggctcttggactcggcgcctcttcgcctttgcggtgaagaggtggcgatcctgggccccgactccttctacaagtacctgggggcgcataccggctacgggcggcaaacgggtggacagcttgtcgatcgagtcgaaaggcaggtcgtcaggctgttcacctcgttcctcacccccacccaaaaactctcggccctgaagagaatagtcctgcccgccatgagcttccatctccgggtccggccctgcgccgaggggcatctccggcgccttgacaacacagtgaggcgctgtgtgaagacagcgttgcgcctgccgaaggggtcgtgtcgggcttttttccacacgtcccccgacgcagggggcctggggatcacgtcggttgtcgccgagtgcgacatactgacggtgacccaggccttcaagatgctgtcttcaccggaccatctcgtctcgctagttgccaagggccgtctggggatgcacgccgcgcgcatgggccggtccgagacggcgtccgcttgcgccatggcggactacctgagcggggactcggtaatggggcacangtcgtggaaaaccggatacaggatgccggccgatctctggacagccactcgagctgccagccggcgcctgtccctccggttttccccgcagccccaaggcgaattcggcctcgagtcgggcactttcaagatcgcccccagggagcggcgctccttgacccgaaggctgcaccacaggcaaaacctgtggtggcggaaccagtgggcggcccttcccaaccaagggaagaccgtcgccgcccactccgcctacgcagcctccaacaactgggtcaagggcccgtcctccctggcccctcaggccctgttcttcggccttaaagcgcggctgaaccagatgccaacgcgctcggtcaaggcctgctactcaagggcgccgaactacgacaagtcctgtcgtaggtgtggcgcggaggtggagaccctcccgcacgtgctgaatcattgccccaagtccatgaaatcgatcttggagcggcatgattcggtgcttgcggaggtcctcgccgccatccctcgcggcacattcgccagtgtcgacgtcgacaggacgtcccgagaacatttccggcgagtgggcgaagctctgcgacccgacatagtcgcccgtcgacatgacggatccgtcgtggtcgcagacgtgacgtgcccattcgagtcctgcgcgtcggccctcgatacggcggccgcgcgaaaaatcgaaaaatacgaccagctgtgtgcgaacttgcggcagttataccgtaagcccgtcgagtcgcacgcactggtcgtaggttccttgggcagctggggcaggaccaacaacactgctctggctgcactcggaatccgaggcgcggttcgctcgaggttggccaagcaattggtcaacctcagcgtcgagggtagccacaacatctggctacgctggtccggcggcatcccaaaggacctggtcagataagatccgcggctgtggcgccgaacgagcacctgcccattcttcttgtagggactttttcaccctcactccccccaatagttttttttcgttttttcgttttttcacccccaccccactcgcctctgggctgcacatcccacacgtagggacctgtttatattatttgccttttatatgtaccactttttaaatatatttttgtaccccacaagatgcttttcgccaaaaaaaaaaaatttttgtatcacatttttatattttgtaaaacacagatttttataaactttgcactatttttatataaacttcgcacttatttaaaatgaatcgcatcttttttatatacaccaacacaaacaggatgtgcagctcaggggaaccaatcctgcgtccctcctagcggcgggaggggcgcccacctacccccacgctcctcttgagcaccaacagggactcccttccggagcccctgcaccctcaacttttcttatttttaaaaaaaaaaaatcatatatattgatcttgacgacgggggctacattcagcccccaaaaacccacccaccatccccaacgagtgccggggcattgaagagctccggcacaattagcacttagcttatttattattttttgtcaacatttttgttttttcaaattttttcacccctcacccccaccctaataggtccctcgggcttgggcccctttttcgtgctcgagaagcgtcacatcgccccactgaccacgaccttccccgacattggagtccttggcgtctcccaggtcgaaacagtcccaagtgatagcacctaatgctcgacttgtttcggcctgggccgccgaggattcccagaacgaccattcttctaaataatatttatatttcagaataaaactatatatatatcgttggcgggacttgtcccgcctcgataccgagtgctgcagagcggcaaaataaagaagaaaccgacgtcgctctgcagccaaggaccacccaaactcaagccagcaccgtcgacaaccaacatcctcaagtcggcggttgctggaacaactcataacatcttcaanataaattatcaccctgtgcagcaggaggccgtgcttttaaaactactctgtagtggctcatgataatatttcgctccttttttgccccgtgtaaacttagtngatgcgaataaaatcagttgaatca

SEQ ID NO: 1127 - DNA, 4134 bp, Bombyx mori
gctagctccctaaaatcctaccttacgtccgaggcgaacatctgtccacgtggggagcggaaacgcgtactatcgaaacttacgcggctaacaaggtaaaggtaacccattaatatggagacaagactaaaaagaaaattgagagggccgcttcccgggggcgatcgccggggcacacctggagctggcgctgggtgttccagcataggatccgtcagcggcggagagttgagcaggcgggctctcgccggggatttacaacccgaaaatgctacagccgccaacagaaatcacgatgtagaaagtaggagcaatagcccatgtgaaccttacagcccgagtaccggttcatacaacccctcggtacaatcatcaccatcatcctcgggtcatagaggctcaccaacgtcgactatggatgttgcgcagggggcgaatctttttacctgcgtccaccaaagctggcaaaacaaggggccgcatgaaatggagcagagaagtaaacctatttatcatgcgcacctactactacgtcactaaattagaaactgatctgactatttacagaaaaaagctgcatgaacatttttcactaaaataccctaatgtaataatttcacagcaaagaatatctgaccaaaaaagggcaatagaaagaaataaactactatctcaagaaaccctagaccgactaaaagaggaagtgagaaaacagctcgaagacgaacaaaccaataatgttgaaaatgaaaaattaaattcagaaacatattcacacgaatatacgacacttactccacaaactattttaacgaagaaaacacagcaacatacaaatattatctctagcacacagacctctcattcatccactcaaaccgaatcaataactctgctgttagaaaatgaagtcgatattttaaatactaaccccacagaaggggcaacacagacacaagaagttaaagataaatttgaaacgaatttaacaatgtactcaggcatggaccctaaagcaaggccgccattgcctaaacttaaatatagctctaagctaaatgaactgatacgtctatttaataatgacatacttgtagattacatctcaccagacacacaactatcagatgtacatacattaacatattgcaccgccgtaactatttcggaacaactaaaatataaaattatagcaatagaaggaaacgcgagacataaaaaaaacttcaaaccaccgtggcaacaaagattggagaaggatatagcaaaattgagagcagatattggtaaactgacccaatacataaataataatagatctaaaaaagtagtccaaagcgttgaacaaatatttaaaaacactaaaatacacacatcacacgaaaatggcaataaaaaatctcaagaatttttagacacactgaaacaaaaattagctctaaaagcccacagactaaaaagatataacaactcacagaaacgaaagaatgagaacactatatttctaacaaatgaaaaactattctacagaaacctaataaagccgaaaactgatcgagacaatagtaatatagatataccaacagcagaacaattggaaatgtattgggctaggttatgggaaaatagtgcaaaacataatgacaaagcaaattggattactgaagaaaaagaaagatgggatacaatagaagaaatgcaatttgatgacgtgacagaggaagaaataactactataacagctagactacataactggaaatccccaggtatagataaaatccataatttttggtttaaaaaactaatttgcttacacaaaacaatagccaaaaatctaacagatattatctctggaaatcaaagtattcccgaattcatagcgacaggaatcacttatatgataccaaaaggtgacttctctatagaagcatcccaatatcgaccaattacatgccttccgactatttacaaaattttaacaacagttattacaaagaaaataaattcacatatagaacacaataatatcttagctgaagaacagaaagggtgtagacgaggccacatgggctgcaaggaacagctaattatagactcaaccatcatgaaacacgccaccacaaaaaatagaaatttacactgtacatatattgactacaaaaaagcttttgatagcatcccacattcatggctgatccaagtcctagaaatctacaaaattaaccctataataataagcttcctacgcaatatcatgacacattggcaaaccacacttaaattaaaaaaccctcctaattttgtaacaacacgacaaatagccataaaaaagggtatttaccaaggtgattctctcagccctttgtggttttgcctcgccttgaacccactatcccatcaattgcataatgaccgggcgggataccgcattaaacaacaagataacaccgaaacaataatatcacacctgatttatatggacgacattaaattatacgcaaaaaatgacaaagaaatgaaaaagttaatagatactaccacgatattcagcaacgacatcagtatgcaatttggacttgataaatgtaaaaccgtacatataataaaaggaaaagtccaacccggtgattatacaatagatgacacaaacacaataacggcgatggaaccaagtgacctttataaatatctgggctttcagcagctcaaaggactcgatcatataacaataaagcaatcattaacttcagagtacaaaaaacgtatcaatgccatttgcaaaacgaaattatctggaaaacatcttataaaagcactgaacacctatgcaatacccattctaacctactcatttggaataataaaatggagcaaaactgacatagaacaaatagaacgcataacaaggactacattaacaaaacacaataatcttcatccaaaatctgcaatagaaagattgacaattaaaagacaagacgggggtagaggcatgatagatatttggcatctatggcgtaaacaaatacacagcttaaaaacatttttctacataaaatcagatttaagtgaaattcacagagccatagcacaaaatgataacaactacacaccgctaaatctcaaacaaaaagaactaatagataatacagaaaacctaagaaatagaaacccacaaaaagacatggaagaaaactggaagaaaaaagcgctacatggacgacaccctcatgacctaagccaatctcacatagacagcaaggcatcaaacatgtggctcaaaacaggaagtctgttccccgaaacggaaggatttttaattgccatacaggaccaagtaataaacacaaaaaattacagaaaatatattattaaagatcccactattagagacgataaatgccgcaaatgcaacacccagccagaaaccatacagcacataactggagcatgttcaacccttacacagacagattacactcacagacacaaccaacttgctaatattatccatcaacaactggctctcaaacataaattgatacaaaatacaaacacaccgtactacaattataaaccacaaaccgttcttgaaaatgactcctgtaaactttattatgatcgcgctattcttaccgataggacgattcactacaatagaccggatatcactttacaagataaaaacaataaagtcacctacattattgacattgcagtcccgaatacccacaacattcaaaaaacgtttacagaaaagatgacaaaatacacagaacttaaagaagaaatagttagaatttggaaacagaaaaaagcatacatagtcccaataataatctcaaccactggagttgtcccaaaccacatccacaacagcttaaagcttctagatttaaaagataacatatttatttcactacaaaaggcagctatcctaaatacatgcagaatagtgagaaagttcatgcagcttgaagaaaaccaaacttactacacgcaataaaaactagcataattattaactcataactaatgtatattacttggccaaaagcccgtatatacagttccaccggctctgtcgacagactgaactgagaaaggggaaacatatggaaataataataa

SEQ ID NO: 1128 - DNA, 3848 bp, Anopheles gambiae; identical to SEQ ID NO: 123

SEQ ID NO: 1129 - DNA, 4856 bp, Bursaphelenchus xylophilus
gggatcctgggttcctactacctcgctccacctcctcgcgatggatcctggggaagtctccggactgagctaagagagcgttaaagtagagggtgacggcgtaagtacctccaagttgcggtggagcggaacatctactcttcggagagaggggaagctctatggcggcgttagaaaggttggactacggcaacgccagggagatggggaaggttcatcaggtgatactagttcgctactgtcattcgatgtatccggaaccatactcgccaagttgtgaactatgtgaaagtctggatccaatccaagaccacggggcgcaattaaaaggtgtgaagcagcttgctggtgatcaccacggtggtacctacaccggcgggggaacatctttaatgccgagatgaccgcgcgaataatagggagccggcaaaagccgagcgtaagtggaaaggatacagaaatttgctcaaaagtataccaacccgccacttataaaagaccgagaaaagggtaccactagagctcattataaaacatctatgacatgtaataatgctgtggtctttccgccagccgatggtaaccccgctgggactgcggataggaattttgctattaggttcccctccagtgaacctccaggaccctctggaatacgaccttctgagcctctggacggtagaaccgggattggcgacgttgagcacgcccaggcgggaaatggaggattcctggttgatgttctggaatataaagaagcacatcgctacggctccaagtgtgagttttgttatgtgcaaaccaaaggtaccgtgtgctctaagcctcggaccgatgcgtggttgaaatgcgagattctgttcttgcttcatcatgcctatacggctaatcagaacaagagtattgaactcgccgagagtgcttttcggcgagcaggaattacccgacgtagcaaggctaccatcgcgaaaagatggtccttaatacagcgaggtaaaggcaccgactataaggaatactgggacgagtacttcgaaaaattcagatacgagtgcaaccccacacctatagtacggcgcaaacgaaacaggttagccgctgggttacagtcgcccagcagcgtgccgaacggatatgaatttgagcggaaaaggacttgtgaaacgcctcttgataccaaggcttcaagtcttccactaatctgtaacttgctaacaggaattgtcggagttgagaatgttgaggaaaatatgagtgtagaatgcactgagccgaaagagctaagtggaactgcgaactcttctgttccgggtttggcagaaggagtatatgaaagacgacataacaatgtcaacgagccagcggctgggtgtccccaagatgtcccagtcgcaaacaacttgatcgattccccaactactaacgatcgattagaagctgagtttaaggcacagctggatagagcggaacggtcttatatgagacgaaggctacctaggctgaagaacctatcccctgacgaaaggatgtggattggaacaacagtcgagcgcctaagactcgagactgtgagcgaacctgtatgtgaacagtggcggcttgccaacgctgggctatatgcagctatccggtcaatcgcggtaatgcgccccctggacgccgcccgcgaagcccataaaacttggcttctaaatatgaaaatgacggaaaggaaactaagacagcagattggctgggtcgagacgacgcgccgtactaagaacgaggcacgtactgaaagacaagaaattgtctatagaaaagtggccaaactgcgaagggaaagattccccgagatggacctggacagtgtgtcagtccacctcaaacgcaagcttgagttacttaaagggcggattcaagtgagaaccgcagagaggttgcgaagggataccagagaggccgctggtccatatggtaagactgctcttcggggtcaagggtttgccccgaatgtaaaagacgcgactcagtactggtctggattggcccagccatccggacaaaaatgttctgagaactcggcgattctctcagattggaaagaactcgtcgagtgtaatttaagcagcttgccggatcagatggagccgctggtagtccaaggcataagtcgggctagtccatggaaatctcctggaccggacggtatttttaactactattggcgacaagactttattgtggactggttaaagcagctaatgctggattccttgaggaccgggcactatccgtggaaactttcaagtggacgcacggtgctcctgtacaaagacggggatccgaccaaagccgagaactaccgacctatcacctgcctaaacggatgcttcaaaatgatcaactcggttgtttctgaagttatcctgaaacgcgtcgaaaatacgatagctctcccgatagagcaaatggctttacgacgtaaggtatgggcatgtgttgagtctcagatatgggatcagatcaaacagcggaagctgtctgatcgaacacagaaatgcaaggtagcgtgggtagatttctcaaaggcttatgacagtcttaaccatgatgctataaagttcgtcataggagttctaaagcttccgacaggtattaacaactacctgcttgacagtatgcagaattggagcacgcacctcgagcttaaaagctctggaaaggtagtacgaggccctagttacccgattaaaaggggcgttcttcaaggcgatagtctaagcccaacactgtttgtcgtggtgaccagtataatagtacgtcatatcaagacgatcgaaagtagtgatatacaaatgtatatggatgatatcaagttgtatggcaaagatcaggaaactctgacacggctaataaaagagctgcagacggtatcgaacaagttaggtctatgtatgaaccttaagaaatgcgcaattctcggcgacgacctcccagaggaaatcaacgggattgagcaccttaaggaatcatataagtacttaggtgttccccaacgggaaatcacccaagtgcgtgccaccatggccgcacttgaaaagaaaatactaactgaagtagatactagtcttggagcagccgaactaagttaccgccaacggatatcgcgtgttaactctaagatcgcgccgttggtgaggttcgttgtgcagagtatgctggtcacgccacgcgatgtgcttaaagtgtacaataggcttggaggcattgatgtcgaaattcgaagaagactcgtcaagtacgagatcagatacaagaaaagtaatgtagcccggctctaccttgatagaaaagttggcggcattggtttcgtaaacctctgccggataatggtcgaggcggttgcagccagagctgtctactgcagacttgctccctcgtttaatgagttccaagacttccttgcagaacagaataccagcccaatcactgctgcacagacaattttagataagtgcggcattaatattgagctgagtacatctactctgggagatgtaaagaaaatagtgcgaaaccactatcacgagctttggctcacggcatggaagaacactgggctctataaacgttgggagaacgaccatgtagacattaaaagatctagtttatggatcaatcgaggtaacctaagtgcgaataacgctcgtattggaattggcattcaagacaacagtatcttttgtcgaggctttgttgggaacaagtgtgatacgaaatattgccgattatgtggggatggcatagaatccgtaagccatattgtaactggttgtccgactcaccgtacaaacctgtacatagagcggcatgactgtgttgcaagaaatgtttacgcatacctcgccataaggtatggaatccctgtgccacactatacgcagcgagtcaagacaatagagaaaaacggcgatcagtctgtagagctatactggaattacaagttcccatgcacccgtgcactggaagcttgccgtccggatattgttctcatagataaggttagtaagcgaactcatataattgaggtggctgtctcatggcggggacggttacaggaaatggtcgataggaaagtgtacaagtatacggtaaacggagaatacgaagccgatggctcttcccgtgggtggaatatcgtccgtgaactaaacgatcagtacggctttcctgtcgaggtatatacgctagtgattggtgctggaggcgaaatcctaccatgcacggttaaagatgtagaacggctcaccggtggagcggctactgataacctcattgagcgtatggagcggagcgcagtccttggctcatgtcgtatcattaaaaggcatctggcactctaagaaaagcatgaaataataagaaatcagataagaataacaagaatactaataagtatatcatgtaactatgacaaaaagaacgcaccaataagaacatgcttgagtggccagctctgcaggcaaaagtcgaatttggaacagccggtaatggaagacctgcaacaaacgtggggtagcaggcaatatgtaactatgacagaccaaaactccgaaactctggtaatgagcccgtgccccccaagcatgtggtctcgttcgatgtagttaggaacagttctctttaacccgtgatgattacgccctgtcttaaatggcaggtgccaccaaataccgaacactcgttgaggtatggtggtccgaatgtgaagctgggagtacaatttggtacgagagcaccagcgcccccgatctaagtgatgacgcatgcgtcggaacaatgaagacggctggcaaacattcaggagtcgcaaa

SEQ ID NO: 1130 - DNA, 5012 bp, Heterodera glycines
  modified_base (4992)..(4992): a, c, t, g, unknown or other
tggcgatactcggaacctccggggagcctggtaggagttggcctacaggtcgcgaaagtccctaggtgctgcacgggttgcgctaatccgagggcgctgggttaccttcccatcggccaaaaacgtctgggccttcttagccgcgggtccagtatttctgttgagcctgacagttcttcccggatatggcgaaagattacagggcggtatttcgtgaaacctaaaaawggtcgggccgaatggcacggacagactcacttcggagtgagctcgggggcatccgtgtgttaccccgctgcaccacgccgaagctgtcatagcgagcccgaaggggaatggccatggagactccagcctcaccctgtaactcgaacctaagtccaggcccctttctggtgttggctcgcactggttaggaacacgacagtctcgtgtaatcccacacgcaccgaaagccctagccctcgtaggcgaaggctgcgttgctggtttcagaactgtgagcwagtggggttcggatggccgagtgtaccaacctgcttgctaacaggtagcatagagtaatatgctagtaagcagggcacgagaaagggccgtaaaggctccggctatgaaggaccttgcgaccacgcgtgtgtctcccacgtgcggattcttgaagccagagtcttgcactgcgcgcaggatggagcctgtgcaactcctccctcgctgatcgcaggagtggaggatcaccactctttttaccttgctagcttggggtaccaccttgagctggggccggccttgctagcttggggtacgaccctttgagctggggctggccttactagcttggcgcgccacccttggagctggggtggcgcaagatcacttgtatacggtctaaccaatacatttgaaaagcgatcaaagcgaaatgatatcctgtgatttggaaagagaaaccttaacccaaatggctctctttagagcccgcagtgacaagacgccgacccacgccgggataccagcccctgatgaggtccgagagggagggtgcggccaaaaccgaaccaatcccgcggccccccgtggtaaggcggcagcgattcaaaggcaaaacggcataactattcctataaawgcctgcgctcaatccggcctagtccggacccagagggttcagcagtggtcagccgtggaggagtccgccttaaaggatgtggtggtgcgaaacacagacgaccgggggctcattaattgggccaaaggtgtgctccctgaatggcaaagattgtgccagctcaacccgaccatgtacatggctcgatcgtctccatcgctgtccaataagtgggcatctctgcggcggacccatgttggtcctggatgcccttcgaaagaaggctccgggccctcacaagacctttcagatgtaaaaatccaaccagccaggttggcccatgatacggtggccgagctacctcaacgtactgtcccttgcggcacagacggtcatggtgtaatcgattccgatgagaccgagactgccttagcwgaggtatcccggtcgagtccctttggagaacgcgagccgctcgacttaggggcgacagagaggatcacgcgtaagcggctgcgcaacgccgttcgcgatgtggttccacctcggaaacgcagggttccatccaccccttcacgtaaggaacaagatttggttccagaggtggacgggcctgcacctacggatgtgttgacacacccacccacagaatccgaaccagaaccgatgcttgacccactctcacttgtccaactggtaaggccgcaattaggccgggcaatgggatgggcagccgaggagatggaactcgggaatgtcgtgatggacgtggagctgaagagggagttcaaccgggaggtgaggcgtgtcggaagaacgcctcccgaccaaatgtataagcgtggcgcaggtccaccactcccacagaaacgagagcccgaacgagtagccctactcgagcaactcattgcggcgcgcgtggagcgtggcatcaacaggggacttgattggttccttgaactgaatgtcgcggtctttgcagccgctagggttctgagccgccgggagagagtggaaactcttgctgatcggctgcacatcaacgattctgccactctgtccgaagtatccagacggcgagctaaagccgaaaggaaactccggtgtgcmcgggaacaaccatggatgagcaggcggatcaggawacttggtgtgagggtcgagagactcaaacaactagctgacctggtccggcaaagaatagctgggagaggtaatagatcgtcttacgaaggccctaggcggagattccgactaagaccctctttacgttctgttactgaagcacctgtcaatccaccccttaacgggaatgaagtttacacgttctggcacagcctttgggcgcagagcctccgtgctaacacggatgactgtcaactgagggaattcaaaaaccagctttctgctgcgcgacacacggatctgacgagcgtcggaaccagctcattggttcagatgttcagcgcggcccttcggaaaatgaagaagggcaaagctcccggtcctgatggtatccgtgccgcgtggtggggagtgttccggcgaattgcaccgtatgtggctacgtgggtggtccgagtaatacgwggggcagaaccagtagctaactggatctgcaacgggctcactgtcctgctgcccaagagtagtgacaatgccgaccctagtaactaccggccaatcacatgcctaaatacmtgctacaaactcttcactgccgttatcgcacaaataaccgcaagttacgttgatgttcttggtggcctacctagacaacaagtagcactgcgaaaaggcgtttggggcacctctgtgtccctgatgatcgatgcgctaacggtggctgacgcgagaagagctaaacgcccacttggagtctgctggttcgacttcaagaaagcgtttgactcagtaccgcacaacttaattcgctggatcctgagagtcatcggactccccccggtcatcttgtctgtcattgtctctgtgatggatcaatgggcaacgaggctmaagataggtggaaaggtcatgcccaagaccatcccggtgcgaaccggcgtattccaaggggacaccctatcgcccctgctkttctgcctatckgtktggccaatmtcgttcgccctagaccaatttcctcagtatcagtttcgttgtgcaaaccatcttcagcagggctttagtgtcggacacgtgttttacatggacgacctgaaatgctattgcccagacagggaagtgttgacagcagttattcagcaggtgcagaagagcgcttctgccctcggtctgacgatccactacaagaaatctgcgtggctcgaccaggacggcgggaaaagtggcaaagccgtcttgggtgtaccagwacttgtcggcacttacaagtacctgggaatgcacgagagattcatgattgtaagcaaagacagtcttgagtcagtcaggggaaagttcatggggcggcttaaaaccctgtggacctcgaaactgacattcgggcaggcaatgcttggcacaaagagcmtctgcatgccagtcgtgcgctacgtgctgcagaatctattcctaccaaaatcggaattcaaccagacccgtctggtcctgagagagtgggatcgtcagatcagagacctactggatgaatgtaatatccggcaggttttccgaagcaagacggagttatatgtcagccgcgaagagggtggctggggtcttcctagcatggaagacgccctcgaggaagaggtagtcacaaaacttgccatacttgttgcaagacaagaaactgagccgttgttccgggtgtgtgaagctcttgaaaggaaaaggtgccccacccccctgtccctaggattgcaaatactgaaggactggggagttggggtagagttacagggccgcacattgctgctgaacgggaacacagtgggcccatctcaggcaaccagaaaactcactggagaactggtcctgaggagggaagcggaacggctcagtagatggagaagtaaagtgaaacctggctgtggcatgactggaggggcatggcgggatgtgcccggaatcgatgtccatcttagcaataggtggctcgtcaaaggtgcactgtctccgaccgttgtctcaaacagccttgccatacgagcaaacacggtgattctgagagggagtggcgggggctacaccaaaggtaccctcctccggtgcagaggatgtggtaacacgggagaaacacgcagacacattgtgtcagcatgctccctgggaaggcagaagggggctgcctcccgcaggcacgacaacgtctgcaggatattggtgcgagccatctgccacaaactcaacattgaaccgcccaactcagccaacttcccccatgtcgttgtgctggaaggcagtggtgctaagatgtggatagactttcccttcgtggtgccacataagatccgccacacacgacctgacatcgtcgtcttgtttgagtggaacggggtcagacgtcttagtgtcatcgaagtggctgttagcgatgtggcaaatatgcaaacacaacacatccgcaaatcccacagatatggcaccaactcgactgaacccttcgtcgcgggggtcacgcctacgtataggaatgactgcctggcagcgcagttgcgagcgaaatttaaagcccagcaagttgatgtgatcccgatcattgtcgggaccactggtgaaacattggatggcgagtttgggcggatccgaaagggtttgcctatgctcactaaactgcagatgccaaggctgtggtcagaaatccagcgggcggtgatcctcggatcatatcgaattttggttgaacatcttgcgctaccaaaggggggcgcttgaggactcanaattgacaatacacctcaga

SEQ ID NO: 1131 - DNA, 4446 bp, Parhyale hawaiensis
ccgaccgccagcgggataactggcaaaccctgtctcgaccaccggcccgtgaatccatcggggcgtatgagtctgacacaggggggtgtttaaggtgaccctgttgcgaggaaatgcgcagcaaaagccggatgagccttagaacatcgaaggccaacgacaacctgccgaaagactggcgactaatccagtcaacctcctgtaggtcaccggctggtcatgctgaatctcagcttaaccaggcgtacgaacttacagttggagggtcgagcacccctgatggctgaaaaggaccatcaaagtcgaaggtagccaacgagaagaccaacggctgattcaggcggaagagtcaactcgttgaatgcgttcgacagcttggggtagatggaactcctaagccctgaaaggcagtccatcttcgcagacgctaaggtgccccgccgcctgagggttatcaggccccgccgcctgagggttaccaggcaaccatgaaaatgagtcataatagagataccccttctaacggcgtgaagggtacctcagttagactgggtacctcgctcgtccggtctcctgtgggtgaggcaggggccgttcgtgaacgcggtactcacccgtcggaatcggttagccaggattccgacgctagtgtgaatgctactggagaggggagtgtgagggagcaggctcccctttctccgccgggggcggaggaggctactgtcccgacgcaacgccgcacgcgccacaagtggtccagggaagaccgagttgtgctgtgggagtgcttcgtcgccagcaagcgcgaggggccaggctatctcaagcgcctcaagcagctgtgggacgagagaggaatcccgggcaatttcccacaggcttctcttagtggccaaatccggcaaatctgcagcaaaaacctcctcagcgaagaggaacggcttcaaatcgctgcgcggatggaagctcaagttgcctctccatccgctgacgaacctgcacgccaggttccaacccgacctgtgaccccgcctaggtccccacctgtggaacctgctaggcggccctccattccatcggaggaaacccccgacttaggcgctgtcccgtctgagatcgactctgccgaccccaaccggtcgccctcacgtgggcctaggcacttaccggcccacaatatgagccagagcgagtcagaagacgatgtgacagatcccgacgtgtctgaccagcagcggagtgactcgctggagccacgggacttactccgaaactccagcgtagaatcaacgccaggtcaccctaaccaggaacttagtgacaccctactgtcgaactacgtcccatctgagatcgactcggacgaccccaaccagtcgccgcgacgtgggcctcggcacttaccggcccacgatatgagcctgagcgactcgatggacgaagagacagaacctgacctatccgaccagcagcggagtgacttgctggagctgcgggacttactccggaactccagcgtagaaacgacgccaaaaggtcatcctagcctacgacatctaccggaaccgaagatccgagcagctgctttccgcgtcaactcagtgattggtaaaatccacaccaacaacatcactgagacaaacgccctcatcaaagctggagcagacctcgcagtgaggatccttgaggtacaaccccgaccgcaacggacccagcggaaaaaggatcctccttggaagcaccgcctcgagaagaacattgctgagatcaggaaacatctcagctggatctccgaatggcgcagaggaaatctccacgacgaggaaaagaagacgctgctcgaatcgaggtaccggtgcctcgaagtcggcctaaccaacttagaagataccttaaagcagcggctatctgctaaaaggagcaaagttagacgcttcgaggccagagtagctggattccatcagaaccagctattcaacaccaaccagaaacgcctctatcaaacccttagaggagaagagacgagctctgactcacccaacgcagaagagagcatccgattctggagtgacatctggagcaaagaggtacggcacaacaataccgcagaatggctccacgacgtcaaggagaagaacgtcgcagcagatccagaccttacaatcaccagtcaacagctcaaaaagcaactgagcaagaccaagaactggaaagcacccggaccagatatggtgcaaggctactggatcaaaactttcacatcgctgcactccagaattgctgcacagctcaaccactgcctgcaacgcggaaccgtgcccacctggatgaccacagggaagacggtcctaatccagaaggacaaggcaaagggcacggaggtcagcaattaccgcccaatcacgtgcctcccccttatgtggaaggtgctgacgggcataatctacgagagagtctaccaacatctagactcaaagaagctcctacccgacgaacagaaaggatgccgcaggaacaccaggggaacgaaggaccatttgctcgtcgacaagctcctcacgaaagatgccaggagcaaaaagaaaaacctaagcatggcttgggttgattacaaaaaagccttcgacatggtccctcactcctggatcctggaatgcctggacatctacggcattgccggcaacatccgcaatctgatcgcgacgaccatgcccaactggaagacccagctcacaagcgccaataaacacctcggcgaggtgagcatcaagcggggcatcttccagggcgactccctatctccactgctctttgtcctgaccatgatccccctctccgagaccctgaacaaggccggccagggctacaactacagtcgtaccatgaagctcaaccacctgctttacatggacgatctgaagctctacgccaaatcaaaggaccaagtagagcagctccttaatatagtccatcagtactcccaagacatcaagatgcagttcggtgttagcaaatgcggagtccttaacatcgaaaggggagaggttactgcgtccgagggaatcaccatcgaagaaggtaccatcaaggatatcgaggaggcaggttacaagtacctgggtgtcatggagtataacaccattctccacagaacgatgaaagattccattcggaaggagtacctcacccgactccggctcatcctgaaatcacacctcaatgggggcaacaccatcaaggccatcaacacctgggccgtccccgtagtccgatattctgctggcattattaactggaccaagaaagactgcaccgacatggacatcaaaaccaggaagctcatgaccatctatcgagcactgcacccaagatcgtgcgtagacagactctacattaacagaagagaggggggccgtggcctcatcagcgtcgaggactgcgtcgaagcggaaaaacgcgctctctcccaacacttcagagagagcgacgacccgtgggcacgctgcttagtcgaggcgaagttgctgaaagagaccgaaacggctgaccaattcaaagagcgacggcgcctcgatcggactaacaaatggaagagcatgaagatgtccggccagtacctcgaagctgttcaggacaaaatcgtaccagactcttggaactggcttctgaggggtgagctgaaacgggaaacagaaggcaccatcctggcagctcaagagcaagccctcagaaccaggtacatccaaaacaagatcgacaagagaaacgtccctagtacctgtagaatttgcaggagctcggatgaaaccatcaaccacgtgataagcgaatgcggagtgctggcgcaaaaggagtacaagcgcaggcacgataaagttgcccgacaccttcactggaccctcctgcggatccataacttcccggtcagtgagaggtggtacgagcacgaacccgcgcccgtggttgaaaacgaagccgtgcagatctactgggacaagaggatggaaactgatcgagtacttcacgccaaccgaccggacatcgtcgtcaaagacaaacaggagaagtcggccaaactgatcgacatttcaatccccttcgactccagaatcgtggacaaggaagcggagaagaaggaaaagtaccgtgaccttgccatcgaactccagagactgtggcagatgaaggtggacgtcgttccagtggtcatcggagctctgggggcaatgtccaagaatctcaagactgccctgcgagagctgaagtgcggccatctccacccaggaaccctccagaagagcgctctgcttggaacagcgcacatcattcgcaaagtgctctgagccttaggtcgcgggatgtgacccggcgccagagtgtagagctgaacatcgctcaaccgatccaatttgggtcgtgaaatcccctcgataataataataataa

SEQ ID NO: 1132 - DNA, 5225 bp, Bursaphelenchus xylophilus
gaggatcctgggttcctactaccctgctccatctcctcgcgatggatccttggggaagtctccggactgagctaagagagcgttaaagtagagggtggcggcgtagtgacttccaagttgcgatggggcggaacatctactcttctgagagagggaaagccctatggcggcggtagaaaggttgggctacggcaacacttgccatgatcagattcgatcaaaattagcctctggggctggcaaccctacaacggattgtaaactgaactatgctatgcaaaatgaaaataaaaaatgggggctttacaatctaaggtgttggcagatcacgaaaactgcccgtcgatgagggtgagataacatcctacggaacagcccctgctggaccaaaccaaatcatccacaaattggagggttttcttggtagtttcccttggcacgtcttgtttcataagccagaataaaaacgataccatacagacatgaggctgggtacctgccagccgcgacacggaaaaccggtaggtgcaaccggagacagctaggggaaagaaaatagtaaagtgtcgaaaacaaaacaggtagcccctggctagagggaatgggacattgtccgattaggttgccttgacccaatgaaagccaaccgggtttacattatcggtctaccaagggcaatgaccagagaaactgcgactatgccgtaacccttcgcagattgccgatgagaaccatcgatcgtaagtcgaagccaagcggattgaccagtggagggttatcccgacaacagcatggtattcaataattgtaaacctaaacacctgtgccctgcgatccgtccgacagggcaacaggaaacgaacggtggtagcgagggcactgctgagcctaccgctggtccttcgagaccggcagtgagcgaggatgcagcccaaccggtgccactgttcgaagagggcgaatatataagggctcaccgcgataagacttgtccttattgcgaagtcctgtggataggagcgcggtcttcaaaggcccgctccgacagctggccattgtgccaaatcttgtacttaatgaagcgcaacgacgacctcagaggtcaaaggacgaggtatccactgctcgagagttctttgagagcagccggaattgcccgtactaagtttgcgattatcaagtgtattcggaacgtgttgagagaccggtatgtgcccaacggcccatactctgagcattggaaaatttaccgcgcgaatagcggggaagttcctcagggagcgaccataacaaaagggaagaggtccgccagagttgcggggcttccctccccaagccagagcggtcaccacacgaaacgaatacaagctggaactggaattgaaacggaaactacggtgactgagactaacacaacacccgaggtttcgcatgaacacagagatccctgcggggaaccagagacgagtgctgctaatgtagataaggtaacggaattgacggaagatgggtctgaaaccagaggaactgcgaacgtcgctaacggtggggtttctgttagcgatcctggtcgtaaaaggcagagttcaagccaaaatagaggaaatatcgaaacgactaatccagaattagtcggtatgtgggaagacatgtttggagtgcagcttgatggagcgatgcgcacaacagagcgaccaaggctacccaaactgaagcacctgtccgaacccgagaggttatggatcagggcgaagttggaacaggcttggctgcagtgcgttagctatgacgtcgaacagcaatggcttaacgccaacgcggttctatacgccgccatcaggtcagtcgcggctagcagaccttgtaaagaggcccgcgaagctcaaaaaacatggctggataataaaaagaaggatgaggcgaaattgaggcggctgatcgggagaatcagctctgtccacagtatgccgaaaggcgaccgtacgccacgagaaaagaaactcgtgaagaatataactaagttgaaaaacacccactatccagacatggattggggtggacttctgaaccattttaaggtaaagttgtcgcaacttaaagaaaagattagcgtgcgggtggcggagcataagcggaaagttaatcgtaacgcagcaggacagtacggcaaaagtgtggccggcagcgcagggttagcgccggatgtcgtttccgcgacggcatactggtcaggtcttgcacaacctgggccaaagaaatttaaagcaagctcgccgatcttccagacttggaaagacgacgtagcgaagaacttgaacactgagccggtactgctgtatccgatcataaaagaatgcatcagaaagccaagcccctggaaagcaccaggccctgacgggatatacaactattactggcagcaagagtttgtggctcagtggatccaaacccttgtgaagagaaccctggatatagggcggttcccgactgcacttatgtgtgggaggacggtactactcttcaaaagcggtgacaaatctatgcctcagaactatcgacccattacatgcctgaatggatgctttaagattaccaatgcggtattgacgaaagtaatccttcaacgggttcaagacacttgcgctcttcccagagaacaaatggctttgaaaccaaaggtgtggtcgtgcatggaagcgcagttgcgcgaccaggcacttcagtctgagatcggtgacgattgtaagactgcatggatcgatttttccaaagcatacgatagtctggaccacgacgccttaagatttgtaatccaaacgattgcactgccggcagggatggaagagtaccttctgaaatccctggatagttggagaacgcaacttgtgctatctgatgcaggtaaggttgtctccggaaagccctacccaattaaaaggggagtgctccaaggagacagtctgagtcccgcgctattcgtcttaacgacgagcccaattgtcgctcaccttcagagaacttgtcccacgggtcgtatacagttgtatatggatgatattaaactctatggcaagacagagtcggacctgtgtatgttaataaaagaaactcaacgagtcgcaaacaaattgggcttaaacattaatttgaaaaaatgtgccctctttggtaaaagtataaaacagagtattgccgggtttgacccgctcggcgacagaacatacaaatatctcggcattccccaaagggatgttgcagatatcaaacaggcatatgacgaactcaaagctaaaacggtgcagaccatcggcgaaacgatggcgtgtgactatctaacaacaaggcaagttatcaacagattaaattcgaagataccgcctgtagtcagatttgtcacacaatctgcgctgtgcagcgcgcctatgaccagaggattatataataaaatcacggaattggataacgtgagtagagcagagttaaggaaagttcttatctataaagcgaccaatgtctctcggttctacctggccacgaaagaagggggattcggctatgcaagcctgcagcaggtatttgttgaagctgttgtgagtagagcgatctactgcctgagagctcccagtctgtgtgacatacgggagttcatattgagtaagttcgaccctgtcaaggttgctcgcattgcgttggcaaggagtaaaattgacatggacatcgaacggatggacatggcctcggccacgcgtaccatcagacaacattatcaggcaaagtggaaaactctgttccaacaatcgaaactttaccaaaagtgggtgcagcataagatcgatatacccaactcgagtaggtggttgcagaggggggaaatctcgccgcgaaactgtcgaatcgcggtagctgttcaagataacactttactgtgcagaggatttgtggggagtaaggacccaaacaaacaatgtcggctatgcaatgctggcattgagaccgctagtcacatcgtgactgaatgtagtacacaccgggttcacatgtatatcgaacgtcacgactctgtggcgcgaaatatatatgctgtcctggcaaaaaattgcggtttttggattcctcattactcacagaaaatcccaacagtaaagattacgaagtcatatgagttgtattggaattacaagttcccgtgcacgcaagcactggaggcttgtcgtcccgatatcgttctcattgacagagcgaagaaaagaatcctcgtggtggaagtggcggtctcgtatgtcacacggctagagcagatgacgcagaggaaactctataaatacggggtgaacggcgagtaccaggctgacggggaaacccgtggctggaacatttgtcgtgaacttgtacaaaagtacaatatgagaattgatctctgcatagtcgtaattggggcatgtggagaaatactcccttgcatggttaaagaaattgaaaaaatatccaaggtctctggtcggcagctcctagaacggtgccagcgtagcgctgtacttggaactgtgcggaccgtaaggagacacttggcaaactaacaagtgtaataaaaaccacccatgcgtagtaaaccgatcaattatctagcaaaatcgcaggtcagaagaccaaagaaccgacccagaggaataggaccagagctgaaactctcagatacgccaacggtcctaataaaacgtcgttaagtaaagcatcgttaagtacaaaacaaaagcactgtaaacgcgaggccccctctttgccaaactccggtaatcctcgtagtacggtgctttttcccgcttcacgaatcagaacgctgccagatcttgtccgacatgggccgtagggtttgggagtaccagcgtggggcggagagcgtacctgggtacactgcataatcgggtctcagaaaaccacctatggtttattattctgtctcccatctgcagggtagcttttcgttgggccataggagcctaggggcaagagtgcatgtagtcttcaacggccatgccagggaaacttgtgagaggtgagggataactagcatcagataatatcagtcatgaaattagtaacaaccaacgttcaccgtcgttggcaaaacaccgactaacgatgctagttagaaagagtcgggtcttcccaaagttaggtgcttgcaccgaagccgatccgctctacccacagctctgcccagcgtt

SEQ ID NO: 1133 - DNA, 5657 bp, Heterodera glycines
tgtggcgatactcggaacctccggggagcctggtaggagttggcctacaggtcgcgaaagtccctaggtgctgcacgggttgcgctaatccgagccccttccggtgttggctagcactggaggggggggggtccaaagaatacgtgaagcggaccctgtgttttctctgacctcatacgggtatatcccgatgatatctatacagtgttcattttcatttcttaacctgctttttcctcaagagaaatatgaccacattcgtttgccatttcgaaggtgcgacttttgagggagttctcagggacatcaagctgttcatggacggcttgacggctcgtggcggcacgcagccgcgcgggccagttagggctggtgccaatgaggcagcgaagaagtctctgaaacgccaaaagcagcgggagaagagagagaaagcggggacgggttagagataatagcatgattgacggcgaagcaatactttgacttccaggtacggaggacggcggcaaaaagcaaaaaggggacgaaaccgatggcattgccaaaggggccgaaaccattgagctggacgctgatgggccgtctgccgcgcaaaaggaggggggagcccctccgtctgggaagaaggtgcggcgccattcgtccaacaaaccggaatagatcttgatgatctcagcaattgatcatattgatctctttttccagttgttgcgataaattatcgtgcattatttcttcgatttctccaaagcttaactcctttcctaatacctactcatgtatacgttagtaggcatgttttatgcaggtaaagatagacctggtgcccccgggcgacttgggatgtggatgatggttggcggagagttctgatgacgccgtagttccggaggaacagttcctactagtgccagcctgggctagtggagctggtctggcgagtgctttgctcgtcagataaggggtggttggggtggtacctctggaatgatgtgtcggataagcactctgccttataaagctgtcgttctgcccaggtttctcctaaccaggttgaacttgtaatgagcctttgggtatctggtcggggtctgcgcggagatagctcgtgaggagctgttattacattattggttgaacgcttttgggtcgtactgcacagataaatatgagaaaaagttttttacaacatatacctgagctttcaagtcatattgctatgtctgtgcctgcgagaaattatcccaaaatgtgctctttagcacagggttcttccggcacattaagtcataatgggaagggtgtcgcaatgcaccggtgccccagcgatgattgtgctggtaaagatccccctcagcgggggtctcaaaaagggaatttgaggagtgtgcgatggactcccagcgaggagaaagctgtcttcgagtattggtcacggttggaacagcatgccatgttaaatggtagcgaagcccgggggacctgtgccataactagaagtcagtttctcattcattgggatggcgagagagagtcaagatccttgtcggatggtgtgcccgagtacccaatgaggacggaaagggcgtactatgaaagggtccgactcttgcgacaacgcggatggcaatgggattgtgctaatgaatgcttagtaattggccaatgtgcagagccatgccgtaagccaaacgtggtagcgattaaggctgataagggtatgaagagatcgctggttaagggaaagcttttgtccctgccccatgtaatgggcgaaataaaccaagtgagcgtgcaggttgaggtgcctttgccaagtgtacccgccagcgtgccccaggtggaaggagttgaaagcaaaggttttactgaaacggaaccgtcgaataaaccttccctggaagggaatccggcggaagaaggattaaggaaaccggagcgagtaaacgtacctgttcatgggataatcagtgatagtgaacggaaagacctgaaagaccggttttggagcgcctataaaacggccaagaggtctgtgggttttagaccggctctaaaaatcgaaccgaatagggttaaccgtgcccagtgggaagtactggattcctgcgttgttgaggtgctcaaaaagagggaaacctccaatgggtaccgcggttgcgtcctccggcatttgaacgttgcagtttatgcggcgggatacgtgctggcggaaggcaacaaggaaaggaggcaggtgatcagacgccagtcggcggaatggttgcttcgccaaaagtccgaaatcaacaacatccgtagacacatcgggtggattaccgatgagttaacacggaggaggacgggaaagaacccaacatccagacagttgagtaattttgcatggttgcaaaggcgataccaggttttgggtaaacccgtgagggaaacccgggacttggaagtccaacgagaaagacttgtaagtcgtcttcgattggctcaggaccgaattaactcttccatggatcgtgaagagcgagttcgtaaacgaatgttacccctgcggagaaagttggaagaacctttgggtgactctaaacttgacacaaagcaggcacgaacattttgggccagcctgattggagagcgaaaggaatttggaaaaatcccggagcttgaaaactgggccgaagaagtgaggagcaaagtcaccgatggacaaggtttcgcaagtgaccatgtggatcaaactgtttggaaaaagatactgggtaaggccaggccactgaaggcgcccggaccagatggaatccccaatttactttggaaacggttaccatccgcaaaccaggcgttatttaagtggttaatggggatcaagcggaaacagctcagtgtccccagttggctcacaaaaggaagggtggtcctcctacccaaaggaggtgacccggtagacccggccaactaccgaccaatcgcttgtttgaacacgcagtacaaactagtgactggtatggtgacggcatgggtatcggaacacctgaccacatactctattttgccgattgaacaacgagcgatggtgtctggcacttgggggtgtacccatgctatggtgattgacagagcaattacgtcttatgcagaggccactggactaccgctttatgtaggctttgtggactttgcgaaggctttcgactcagttagtcaaccgtggatcaggtacgctctaaaggtcgctggagttcacaagcgaatccgatgtcttattggaatccttatgaaatgttggagcgtaaggtatgaagtgttcaagagcgggagagtgttaaggagtgcgcctttggcagttaagaacggagtgttacaaggagacacgttgagcccgctgctcttttgtctctcagtagccgttgtttcttctgcagtaggcagcctctttgattttgaggtcaccatacctggacgaggagtgatgcagcagcagaaccacttgttctatatggatgactttaaagggtttgctcctagtgaagcgtccttgactaggatgttagtaacattggagcgaaccgcttcagccctcgggttgaaaatcaataagaggaaatgcgctctggtacacccccgtgaaagagagaacgaggaaactggaagtgatatcccggtccttggtctacgagacacttataaataccttggaatcgaagagagatttggtatcgttttcgaggatgcgtgggaccgagtccgtaccaagatgtttgagagaatgcgcaccttgctatgcacggaacataccttcggggagttgcgtgcggccttcgctagtacgatcgccccagtagcgaggtacctctttctcaatgtaatcgttggtgggcctagttggagtgaaaccctgacgaaagctaaggacatggacctgcgtatccgacgcctcctgtgggaaagaagagataacgagccgggatggcggtttaagcattgtagtgctgaccgcttgtacctccgcgtacagtacggtggacttggcttcgtgtccgtagaggacactttgtctgagtctatcatttactgttgggcttacgtgcaatgtaggcccgagttggagctggctcgtgaactttttggaaccttaaacaggagtgctagaagcggtataaaacagagcattgcgaaaggagcgcgtaaagtgttccgaagttatgcccttctctcgaaaaattccgcccagcgagtatctgaccttgatggggatgcctccccaggattccgagtaggggaaatgatattcatggaaccaactcggggtgccagagcaatcgtaaaaatcctccgtaaggagaatgattcgcgacgcttggctgcctggaaaggtagacctatgggaggtcgggtcgtgtcattgccagagctcgaccaggttcatagctaccactggttgatccgtgcgaggattggcaggcgttcgttccgagactgcattgcagcacaggagggacagttgaaagcgcgggagcttatgtgtccacatataaatgcgaaagcaaagtggtgccgacgatgtggggacggtcgtgttgaaaccgagcagcatatccttagtggttgtgcttggtcacggactggaactatgttagatcgacataacggtgttgtacggcaagtacacacggctttatgcaggaaatatggactgcccgtttcttctcatgtcgttcctttgcatgcggtaatcgagaatgaacatgccaaaatcctgtacgatgtcgcgttgcatacttcgcctgctggcgtcctccctagggaggatgggagtacgagttatacgggtctgcgtagcaccaggcccgatatggtaatattcgataaaaaagcacgtacgatccttattgtggaaatttcggtgccatggagagagaacctggttaaacaggagctcataaagtggcggaaatatgccataaattctatgatcgaaccattggaactagcggaagctgaaataccgggacctaacctgaaacatgcgttaggccttgcgtacggtacgagtttcccaacagtgaaggtggtcccgatagtagttgggtcgtgcggcgaggtattaccaaatataacgaagaggctgagtgaacttgggatacctaaacgaggaatcccgagtttgcttgagtcgatacagcgtgctgcgataattggttctggacatgttatccgggcgcacttgagtgtacctaggagcgagtccgagacttagtcgtagcccagatgtcgacagcccctacaccggtagatggaaggaggtatgtatctaagcccacggcaagccaccagtggaaacggtgaccacctctgttcgcggaaatgccccgtagagtatatgaaggtcggagcattgaagcacaagtgagaaccctggaagtatggtggtgagctggtaacctcgaattcctcctatgggtgcttgcgcccgtaggtcatttgtgtatgtagggatggaaggaatctcgatagcgcaaatcgggataccgcactggcgatcatgctgccagtgggccctgctgagttgggcgggttagcaacccgtccagggacgcagatgccaaaagcctggtgacactctaaagggagtctacggcgacgagaacatcccctaagtc

SEQ ID NO: 1134 - DNA, 4513 bp, Strongyloides ratti
cgtcagaagagcaggtgtttttcaaagcaaagacttattctacgaaggggaaagatgatcaaacatgcagatttggctgcaatgaaatagaatcaaactaccatgtggtgacatcttgcaaataccattcatacacaagaagacacgatatggttgtgtacaatatattaaaaagactaaaagaaaagtataagttagatggtgatttacaatatggtagatcagtatttaatgggaagaaggaaaaaattaggatcagatctggccataagtttttgactgaacaaccgttagtaaacaataaaccggatattgttataacgatgaaagaagggaaaaaaaagataacgtacatactagagatgtcgataccacatatctagaacttgaagatgcaagaaagaataaagtataaaaaatattgtgtgagctccatggtaaaaataacgaatgataatgttgattcgatagctcgtgattttaatctactaaatttaatggaaagaaaagaaaggtgtaagataaagtttggatcatttgtatttggctgttatggagaatatgtcttgactgaatctgctctaagaacacagaaaatcctgattgaattgggattctccaaaaaagagatggatagcttgatcaaagagtgttcttacagttaaatgaatgagacagcaagaattattatgaaacatctagaaggcgaaaagaatcaagatgaaatcagccattaataacttttatttacccaattatttattgcgttaacttgattatatgatatttattgtatatttattgtttaatttagtttcatagtacaaataaaagaatatactacgattctttacttttaagttctacgagaacgttgttttagaatattttaataatatttctactacaattaagtaattagaagaaatcaacgaaagcagctaaacttactcgcaaaattcgttgatcgaggctggaatggcaccaactaatatactaaccaacaatagaaaaaaaaagaagaacttcagtggacttcaaataaaataaaattattggtagaattgtatgataaaactgagaaaatttgactaaaacaaaaagattagagcaaatatgtcatcattttcctaatcatacaattaaagcgatgatgacgaaattgagagaatttgaaagagaaaaaagggaaaattgtgaaattaaaatgagggaaaatgaggaaaaacctgaggaaaaattaaattttgacaactatgaagaagcaaaattgaaaagaggaattaagtgtaaaaaagaagtaaaaccaattgttattgaaaacaaggattaggaatttttgaaaacggaaaaattatttctcaagtttgtcaacacaatcaattaccaaagaaagaagggtaaatcaaccagaatgcaaaaatttagtgttccaaaggactcttctcaaatattcttagtggatagtatcctaaacaaacatatttgctcaaccaaaaacaaagttaaggatgtcattaagaggagaagtattattaagacattaatatgtgcagctggtttaactcttagaaagttagtttgtgggaaacttggaaataataaatataattccaagataaatcaactttggaaaaaagaaaggaaaattattaattgtatagaagatttaaagcatttgatagaaacgaataaacgtaggcacaattttgggaaaagattaaggaacgccaaagtgagcccttctgagatgttgaaggattactacaacaagttaagatatattaaaaatgaaattacggcatgcttggatgaacacaaaaaagcaattttaagaacaaaatttaaactaacaccaagcattaagatcatctcaaatattcaaaatcataatgatgaagaggctgaactcccaaaggaagaagaattcgtcaaatactataaagaactatttacaaacaaagatggggatgataaagaaacaccacatcttgacaattggttgaagaagtttagtaagacattaattgtagactggactataaatgacaaggagattcttgaagctttaaaatattgtggtaatttcaaagcaccgggatctgacatggtaatgaaagtttgttacaaatggttcaaatctgcacaaaattatctaatcagatggatcaaatcaacttggtatggtgaatacacaataaataagaaagatacaaatgcagtcacattcatgatttggaaaagagatggtaaaccaaaaaatgatgtcaaatcatatagaccgatttcttgcttgaactgtgatttcaagttactaaacaaacttattgcaaacaagatttatgaatcaatagagaaaattttgcctataaatcaaatggcagtaattaagaataaacatggaacatgtgaagccctactcctatacaaatcattggttcaatcaatgaaatttagaagaacgaaagatgtgaaagaaatatggtgttcatggattgacttcagcaaatgttatgactcaataagtcataagtgtttgaaaaaaatgatacaaagtattaaggctccaccaattattcacaaactcattttagatggaattgatagctggaacatatcaatttgtaatgggaaaaatatttccaaaactaaaatacctgttaaatctggtattcttcaaggtaaagtggctagctctttatattttgtattattgactggtgaaatatcttatgctttgaacaaggaagaacaagtaccaattgaaacgattacaccaagcaacactttgaaaatcaaccatatcagttttatagatgattatcaactgtatgctacatcacaaaagaaagttgaaaaactaactattaaattgagggaaatagcagaagagatgaacctgaagctgaatccacaaaaatgtggcatatatggcacagatgatctgggaaagagactaatgctgaaagaaagttcattaaactttccatatacttccgagtacaagtatcttggtctggtagaaaattcattggacttaaaggatatcaatatccaactgtttaaagataaaatactatctaaatactcaactatttttgaatcaagactcactacacaccagaaaagaaaagtatttaatagtacaatatctccatgcgcagcatattacctaggtaatttaataaccaataaatgttcaattcaagaactattgaatgaatgtaagaaattcgatcaaatggtcagaaatcagttagtgaaccaaaacatcaaaaagcttcaagtatcaaatagtagaatctacttacctaaagaatacaactcccttggattaaacgaaatagaaattgaagtagcagccaatataatcaggaaagcttgttacattaaaaaaagagaaactcttagaggagtagacaaactatatattgcaatgtcaaaaaatggtcacagaaacactcttagtgatgctttatatataactaaaaaatactctaactttcaaataaattggaatattatgggtatggtgaaagatcaaaacaatattcttctggatgcgaagaaaattattgaaaatatcaaagagaaaaggaggaacctatggctggaacattggaaaaaaggaaacatgacatatgcaaatgaagcaatcaaaaaagaattccatctcccggacctaaacattgactccaaatacctcatgttgtgctatgctggttcagaggaacaaatcatttataatggacacgtaagtttggttaatcaatcctcaccgtctagtagattatgtagaaagtgtaacaaattggaagaaacttcataccatgtggctagtgtttgtgaattccataaaaagaatctacatctaatgcgtcacaatagtgcagtttaccacataataactgaactctgtagaatcatgaaagtcaaatgtacgctaagatatccagaagcatcaggaataataaaaagtggaaacatgaagattgctgctggagtaaaatacacttttggaacagcaaaaatataccataataagcctgacttggtatggtatactccagaggtaatttatgttatagaagtaagtatttcatcactgaagaacgccaaatctcaaatgaaaatgaagactgctagatatgcagtaaactcaacaaagaaattggaaaattttgctgctctgaataatttaaagaagggagaaaactttgttgaaatattaagtcataaagcaaatttcaaaagagtccatttcatgcccctagttttctgcacttttggtgaaatacctaaagaaacaatgaaatacctggaaaaactcaacttttccaatgaaaagattaaaacaattgcttcaccaatcgcacgttacactggaagaactctcaaagcacattttactaattaattagatttatatgtgccactttacctcaaagatatattaatactaacttaattataatttattatgaattataatataataagttttaaaataaaa

SEQ ID NO: 1135 - DNA, 5185 bp, Bursaphelenchus xylophilus
gggtcctcggttcttactaccgtgctccacctcctcgcgatggaccctggggtaggcctccgggctgagctaagcagagcattaaagtaaagagtgacggcgcagttgcttccaagttgcggtggggcggaacatctactcttctgagagaggggaagccctatggcggcgttagaaaggttggactgcggcaacactagccatgatcagattcgatcaaaatagcctctggggctggcgaccctataacggattgtaaactgaactatgctaacctgtcagtaaagacagaacgggggctttgcaatctaaggtgttggcagaccactaaaactgccctttgatgagggtgagataacatcctacggaacagcccctgctgatccaaacaaaatcatccacaaatcggagggttttcttggtagtttcccttggcacgtcttgtttcaaaagccagaatataaaacaataccgaagtacagaatggctggaacctaacagccatggcacagaaaaccggtgggtgcacaccggagacagcaggggaaagattgcaaagtgccgtaaataaagatggtagctctctgacctgagggaatgggacactgtccgattaatgccttatcccgaagacggtcaaggttctatcttatcggtctccaaagggctctggccatagaagctgcgaggaagccgtaaccctacgcagattgccgccgtgcatgataagtcgtagccaagcggatcgaccagtggagggccaacccgtaacagccatgagtttccataatttagaaccaaacaacctgtacccagaaaatcttcgtcctactgggtcacaggacgcgaatcgcggagttgcggacattgctgaggaggtgactggtccttcggggctggttactaacgaggaggcagcgcgagcaccgccgcttttcgtagagggcgaatataaaagggcacactgcggtgggggcaaatgtcactactgcagggtcctgtggataggtgcgaggtcttcaaaggcccgtaccgacagttggaatctctgtgagattctatttttgattaacaaatgcatggaacttggaaacgtgcgtcggatttacagtcctctcgagagttctttgaaagaggctggaatcaaccgaacacgtcatgcaatagttaagtgtcgactagctgtcatgcgtgatcgatttgtggataacgccccatattctgagcattggcgtctgtataacgcgtgtgcagaaaatagggcggtggtcgtcccgatggactcggccacaacggtgaagaaaagaactgctagacaagcgggcttggaatcaccttcgcaaatcggggtcgctggcaagcgagtccacgaagctgaaactggaactgatcggattaacgcggtgattgaaacgaacacaactccgctagaggatattgacttgagtccagagaccccagaagggcttgcagagttgcctagtactgtagagataatggaattgacggaagacgggtctagatccagagggactgcgaacgacgctgatggcggggtttccatcagcgatccactacgaaatcgcccaagctcaagtcaggaaagcagaaatgtcccggagcaagtagacccggatggggaacttgtatgggagagtctatacggagcacagttgaggggagcgatgcgcacaactgacaggccgaggttgccaaaacttacgaaattctctgcagccgaacagctgtggattaaatcgaaggttgagaaagctcggctggagtgcgttagctacggcattgaacagcaatggctccgtgccagcgcagttctatatgccacgatcaagactgtagcggcttgtcgtccgtacaacaaggcccgcgaagctcacaaggtatggctcgagaacaaacgtgctgaagaaaagagagtacgaaggattattgggcgaattgagactgtacgcaccatgccgaaaggcaaacgaactgacaagcagatccgccttgcgcggaagattaacaggttgaaacgtgtcagcttcccagagatggactggcacggattcctgaatcactttaaagctaagttagatcttcttaaaaagttgatctcagttcgggtggcagaacatgagcggaagattagtcggaagatagcaggtacatacggcaaaagtgtatccggtcagtcagggtttacgccggatgtcgttgccgcaacgactttctggtcaggccttgcacagcctggaccaaagaaatttaaaaagaactcgctgatcttccagacttggaaagacagtgtagttgagaatatgaacactgagccagtactgctacacccgctgatcatagaatgtatgaataagcccagtccgttcaaggccactggccctgacgggattttcaactcctattggaggcaaggattcattgcgaattgggttaagtcgctaatccagcgaactattcaaacaggagagttcccggcctcacttatgtgtggtcgtacggtgctcctgtataagaatggtgacactgctaagccggagaattatcgacctatcacatgcctgaatggttgcttcaagatgactaatgctgttatcacgaaagtaatcgttcaacgggttcaagacacctgtgctctcccgggagaacagatggccctgaagccgaaggtgtgggcgtgcatggaagcgcagttgcgcgaccaggctctacagtctgagatcggtaacgattgtaagactgcgtggatcgatttttcaaaagcttatgacagtctggaccacgacgcgatccgattcgtgatagaaacacttgctttaccggacggaatggagaaatatctcctgaagtcgctagagagttggaagacaaaactggtgcttagtaatcgaggtaaagttgccactgggcgaccttacaagattaagagaggtgttctgcaaggtgacagtcttagtccggccctatttgtcattgcgacaagtcctatcgtctcccatctaaagcgtgtttgcccatccggccgtatacaattgtatatggatgacattaaactgtatggcaaatcagagaccgaattacgtatgctcattaaagaagttcaaaaggtagccaacaaattggggctccagatgaatctaaaaaaatgtagtacctatggtgctggcctaacagagagtatcgccgggtttgacccactcggcgacagagcatacaagtatctcggagttccccagcggagcgtcgcagatactaatttggcctttggtgagcttgaaggcaaggtaatacggtccatcgaggaaacgatggcgtgcgaatacttgacaatgcggcaggtggtcacaagattgaactctgtgatcggtcctcttgtccggtttgtagcacagtccgtactaaccagtcaggcgaaagtaagctggatatataacaaaatatcggatctggatagcaagataagagcgaaattagctcaaacaggcctaaggtacaagaaaagcaacgtagcaagactctacctaagcaagagtaaaaatggcatcggtttggtgaatgtccagcaggtattagttgaagcattggtgagccgagccatctattgtctgagagccccgagtctcgttgagattcgggagcatatactaacagcagagttcgaccctgtaggagctgctcgtaccgtgctgcggaggagtaggatccaactggagatcgagcgcgtcgaaatggcttcggctatatcggcgattaaaacaaattaccaggcaagatggatgacgaagttcacccaatcgaaactataccagaagtgggttcaccatgacatcgatctagccaactcaaacttatggttagagaggggcgaaatctctccgcaaaacgcaaggattgcggtagcggctcaagataatacgttactgtgtcgcgggtttgtaggtaatcgggagtcagaaaaacagtgccgcatgtgtaacatgggcattgagacctgcagtcatatcctgactgaatgtagttatcaccgggcgcatatgtatatagaacgtcacgattctgtggcaaggaatatctatgctgtcctggcaaaagaccacggtctctggattccgcattactcgcagcccgtgagttcggtaacaaagacgccgacgtgtgaactttactggaattacaagtttccatgtacccgtgcattggaagcttgccgtccagatatcgttctcatcgatcgcgcgaaaagaactatcctcatagtggaagttgcggtgtcgtatgtcacacggctaaagcagatggtgtcacgaaaagtgtataaatatggagtaaacggtgaaaagggagccgacggcgaaagccgcggctggaatatgatccgtgaactatctgaagtttataatatgaaagtgaacctttgcgcagtcgtgattggggcgagtggggaagttctcccttgtacggtcaaagccattcagagcatatctagcaagacctccagccgacagctcctagagcggtgccagcgtagcgctgtcctagggtcgacgagggttgtcaaacgacatcttgcagaattccattgagaccacccatgcgcagagtatccgaatcagtgaaagtccaagtttcaggacagaaacgtcagataagtccaagagaaacgagaaaacaagttcaagtatgcaagagttaatcaataagagagtaccgtaaatgtatgacccccccctttgccaagtcgacaactgtcatgcaggtgtctctcttttcacccgccatatggaccaaacgctatccagcctcgctcagaagagccttagggctggggagtaccacatgtggcggaaactgaatctggatgcgatgcataccgggagcgcagcgaaatcacttaacgctggtgcacctcctgctatcgtagtacttcctagatagatgagtagggtgggctaaaggtagtcgtcttcaatggcaataccgaggggtctcgtgacaggtgagggataactagtatcagataatatcagtcatgaaattagcaacaaccaacgtcaccgtcgttggcaaaacaccgactaacgatgctagttagaaagagtcgggtcttcccaaagttaggtgcttgcaccgaagccgatccgctctacccacagctctgcccagcgtt

SEQ ID NO: 1136 - DNA, 5688 bp, Bursaphelenchus xylophilus
tgccagcggtgttgattaggtccaagttctttggccaaagatccgccctcggtttagcagtaccgaacgagtataccttcaagtggtggcactgaattagactgaatactctgaactgtagacttttgtgcaactgtgtatggtgtggaagacttgtttgtaccactatcagctttattggggctcgttactgtttcatacaggtagatgtcccctttagagatttccctgcagtttgcgctccaagtcgctagcctcttgcgtgtagtcaaaggaatacattcgccgtcggtgacagggctatacccggcgactacggacttgtttattacgtagtgcagcctcgtttaagacgaatgtgaaaagaaggtgtgattactaagcgttatgagtcgggttatctggaaactccgccccgccgcaatggcttcaagggtcaaactgctaacattttaaaccaatatttggcagcagcagactatgatgtcagagtgccgggggtctatcgatataagactgaaagcgatagacgtggagtgaaaggattccctttgttaagagaatcggtagaattcactttttacttattcaagaacttaacagcaacaagcactcgcgaggattaccgccccagattcggtcggcggtacttcacctgctttcttccactttcggaatctggcatcctggctttcagtgtggtgatggccggcttgagttttcttgagtcgtgcgagtgcctcatctgggacgtccggaccgattgatggagtctgcagtggacgaggacttgatggaccgtaaccatagtatatccctcatgcgtcttctcgactcgagggggtagcttgcactacccacccttctcttctccgattgggatttagacctagccctctggtgtgtctcgacccgcgatatcagattcctgaatcgactgtgagaaatgtctacgcgcaaagatcgacccattgccacccggctatgtggatcgggctcttgactgcttatctccggctttaatcgcttgaggaaaggggggtgtcgcccgaaagggttacgcgatcatccgattcctaccgtaaaaacgtagttgaagtaggattgaacctgagtaccaagtgaaaagagtggctataatgctccatggtataccctagggataaccgtgtcgagcgcactgctcaataccctgatttgttagtgtaggtatgtctagtggctgcctaggcagattcgcctattcactacgtaaaatctgggtgagtaccataagaacctcctgtagggccaggagtcaaactagtccaggttcggtatgcttcggtatactctctcacgggctagtcacctaagagttaagaaccgcctttttctgcactgtgaatagaaaaagaagggcgggagaatatacgggcgaggtaagcacgtcggaacggggtgtgcccaactcgtaccgtacgcccggacaaggaccatctttcgtaccccgttcacccggcacaagtccgattgtctctcccgagaggcgtcggcggaggttggctaacgccgtctctccaaccatcggtttgggtttaagtaacgccccagtggccggtagccaaactgatggaggcagaaatgccggtccgttgctaaatgcgggaacggaccaaaacgccggtgtggtggatacaggtggaagagtcttttggtctacgcaagaaaagaccaggctcaagtacgaatacgaccgtcttcgtgaacgacgccgtcgagacaaagttcgaaatcctacggtcgataaggccatggaaatcctttgggaagatctccggttgaaaattgaagataggtacggtgtcacattgccgcaaagaagcgcaagctctttgaaaaaccagtaccccaaagttattctgcgggggctcccagattcgggcctgccttgggcgggggttcaggtaaatgatactggacaagtcgtagtcgtagaccatgctgaggcggctacccttcgggggtccagcccagcagcggtcgacggggaggccgaagaaccggtagtacccccgttacccgcggcagaggtcgttgaatcggctgctgacgctgcggtgcccgatccgcaaagcgagatcgtggctgaccagggtgtggagacacgccctgtcgagaacccccccgctaatagccgggagactgaaacggaacccgtagaggtagagccttacctcgaagggcagtataaattcttcgtttctaagatccttgggaaatcgatgtggcggaagcctatcaaatacccgaggagagtcccggaaaccctgtggcgtcaagccaatgagttgattgagagatcgattcgacagggggaagtgtcgattcagagcctgaactgcatggtttatgctgctgggtgcgctgttaagtcttcgctggacaagaaggatcaggaagctaagcggcgtgaatccgagtggtatgcgtgtaggaaggccgagattaaggcactcgagaggtatctcaatttcattgacctggagttaaagcgtcgctctgcgtcgcggccgttgacatcaaggcaaaggcagaacttgggtgtgctcatcacgaagtatgggcgtgctcgggttaggtctggtgtccggctctcggaattgcaggcaatgttacgagacgccttagtgggaatccgaaagtgtatggcgaagcgctcggcagacaagaaacggaaacagggcaaatttgttcctattcaacgttacttagagcctagcagtgcggagcctcgactctctccagacacggttcgtgcatattggaatgacattgtgggatcttcccaacagtcaacgtcagattcgacgattcaagactggtcctccaatttaagcgttccgagtcaagagttgaacgcaagtaagatcatggggtggtggagagccgccgtttcgaagagcaagcccaacaaagctgctggtcctgatggtattcccggggtactgtggaaacgcttcaggtcggctagtgagtgggtttgtacctggttatatcgcttattacagaagcgaaggataatcacgccaagatggttgtctgttggtagagtcgtattgttaccaaagaaaggacctctcgaggatcccgccaactatagacccatcgcgtgcctgaacactgtatataagttgataacctcggtagtagaaatggcagttcgagagcagatccaggcttgtcctggactagtcccatacgagcagatagctaaccgtaaaggcgtatggggctgtacgcatgcgagtatcgtagaccgtatgataaccggtgcaagccgagaaggtaagggcggtgggtttccggacctacgcgtcctattttacgattgtaaaaaggccttcgacagcgtaaaccgagatcatatgttcgctgttttgagagtagcaaacgtgaacgttaaggtcgtgcatctactccacacactatctcagcaatggtgtgtccgatacgagctccgtcgaaacaaccgtgtggagagaagtagcccgctgagggtgaaaagaggactgctgcaaggcgacactctctctcctacatggttttgcctatgcatggctccaatatcagcctctattaaaacccttaaccctggcccaacccttcggccgaacatggggaatgggcgaaatagagggcaggtggcgatccaagttagtcatgtgttctacatggatgacttgaaagtgtattgcccccgcgtagccgatcaacgcagaatggaacagaatattccacagttgttcggtgaaattggactaagcataaatgcgagtaagagcgcagcagccgcagccgtgggaagatacgttgaatccgagttgccagttcttgggacgaaggatgagtacaagtacctgggaatagaaagcggttttgttgtaaatgaggtggccgcccttgacagaatgcaggccgttctgctaaaccgtgtagaagcgattctatcggttaaagaacatactgttggtcagaggcgcgacgctatacgagcgaaagcgatccctgggggggcctatatcctgggtcacatcattttgagtgacttggaccccaggggtgctgctgagcgcatgcgtcggttggatatcgagattcggcgtttagtcaaatcagctggtattcttcacgacaagtgtagtacagcgcgtattcaccttagctgtgaacagggaggtctagcttggccgtcgatggagagagcttattatgtagcagttgcatattcagcctcctatcttctgacaagtcaagacgaaactatcagtcgtgccagagactacttcgtctcgggtcgattgagtaacaagtttactgtttacaagcaccttacgagcatcgtagactcccttggtttatcggtagaactgccggatccgaatggacttcctaccggtcaaccgtccgtcctggctagaactattgcgagagcgatagatgccaagttggaagcgcagtggaaggaaactttgctaacttaccagcgcgcagggcgagtcgaaagggcagatccgacggtcgtggaccatgcaaactcataccattggttgagaaaagcatggataaacgagaaagcgtaccaacatgccgtgagtgttatggagggaactcttttggagggagtgaaccctcacggtgtgttgaccatgtgtagagcgtgtaaagctccaagtgcaagcattgctcacatcattactggctgcgccgaattgcgcaaaagccatatgaaggtgaggcatgatggagttactcgctggctatacaatgctctgactgaggtagatggtagcctaccgaagttccactatacgcaacagatcccggcagagatgaggggtgagcgactcactgtccgttacgactcggacatagttactcccaataaacctcgtcacaacagaccggatcttgttgtcttcgactctactagaaaggtgatttatatagtagaggtcagtgtaacgtggttgagtgtgttgcaaaagcaatacgataacaagctcaacaggtatgcagtgaacagtaatcacgagttcagtgagagcataccatatccgcctggtgtgaaccttgctaacgagataagggttttgtatcctcagtttactgggggtgtgaaggtattccctatgattatctcgccaacaggggaagtacacatgcaatttgtgccccaccttgcagagttactcgaaaatccgaacattcctcggattctagagaaaattcaacgctcggttgtgcttggtacagattacattatccggtcatacttcgccatgtaattaggcagtgctcctagcggagtgccgtgaagtggtgtcagtacccgtcgtgtggaaagcccaggagggttagtaccgacagtgggaaacccgctgcacgcaacctaaagacatttgcccttcgggggagaggtatgagaccacactagtcatggttgcttgcgcaagcatgactcattcattgtaagttcgtattatgaggcctcgcggaatgcgaaagtccaagagcgccaacttgtctctttgggaggttcctccgggttccttagggttggcgtaccatgcttcgtgtgagacctaggccgcttggacctagagttaagctgttgcatgtttgaggatgccttaggcggacgccatg

SEQ ID NO: 1137 - DNA, 4686 bp, Ascaris lumbricoides; identical to SEQ ID NO: 388

SEQ ID NO: 1138 - DNA, 4364 bp, Heliconius melpomene
ataaataataataataataataataataagccccctaaaatccaaccatacgtccgagtcgaacatctgattctcgtggggggcggacacgtgaaaataaattacttacacggctaacatggctctggtaaccctttttatggagaatatggaaaataaaagatataatttgcggccgctacccgggggtcgccggggcgcatctggagctaacgctggatgccacagcatgcgaaccgttggcgacgggggactgagcaggcgggttcccctcgaaaaaaatgttacagccgaacaatcatcctcaccactcacttcttcttcctctcattcaccggtatcaagcataccctcaccatcctcaactcgcaccctattaaattcccctaattcatcaccaacatcatcacattcatcactggttataaggtcagcagatgttgtgcaggaggcacttgccaattaccctgcacccactgcgggctctattcgtgcgcgaaaaaaatggaccgacataatgaaccgttatatttggcgcacatatcttattataacaaaatgcgaaaccacgttattgaataattatttagaacccctacatcaagaatttagtagtaaatttcccgaaatgcaggtaactagacaacgtataggagatcaacgtagagcaataataagaaataaactactatcagatgataccttagctcaaattttaattgaagtaaaagaactattacaaatcggtgatcaaccacttacacaaaataacattcattcaactcaactttcacactcaaacactagaataaaatggtcaaacgaacttaatgaagaaattgtcaaatgttactttgaagtcaccctacttgaagttaataagacttcttatcgtaaaaacctgtacagtttatttatatctagaaatccacacctatcacaccttacagaacaaagaatagctgaccaaagacgactaatatttatgaacaaaagtgtacacaacgatagaattattgaattaaaaagagaagtagaaattaaattagctaacagtaattctttaacaaaaaatattacagagtcaaattctcctagcagtcaaacaaatgaaataaatgattctgcatatgtacaaagtaatttacaacccgttgaaccactagaccaacattgtataaatagacacaatttaatagaaaaacattatgttgaacaagaatttaataatgctttaattcaatttaacaatacaaatcctgaaaccagaccctatataccaagacaaaagtcatcgcgtaaattttcccaaattgtcagtttcttaaatagtgaagtacttccaaaacatttaaataacgaattagatttcaatgctcttcataacattatatatacmgctgyctacactgcatctctgtgtaatggaacaaaattcagttttattgataattaccgacctcgtaacagcaagccatcgtggcaaagaagacttgaaagtagaatagacaaatatagattgcaaataggtagacttacacaatatatatcaggaaataggaaccgtaaaatattaaaaactgtagaagaaataaaaacacaatataaaattcattcacatcacgaagaacctaatacagaattaccacatttcttagacacactaaaacaaaaattaaatgcaacttcgaacagacttagaagatatttgacatgtacaaaacggaagcaacaaaataatacattcgttaataacgaaaaacatttttatagaactctatctagcacaaaccaaaataccacaacacaattacwagaacatccaacggaaaataatttgcaacaatactgggccaatatttgggaaacttcaatagaacayaatgcagacgcagaatggttaaataaaatacctgacktagaaataaatktaatgaaattcaaagatatatccatagaaacattcaatcaaatcatccagcgaacacacaattggaaggcaccgggaaccgataatatacacaactaytggtacaaaaagctaacatgcactcattcacttcttcttaaacacataaaccagttcatacaatcaccttgcacactacctttatttataacaaacggaataacgtatatgttaccgaaaggcttagatcccacaaacccagctaactataggccaataacatgcctccaaacgatatataaaattatcactgcgtgtattactgacataatttataaacatatcgatcaaaataacatattagctgaacaacagaaaggctgtaggaaaaatagtcaagggtgtaaagagcagcttactatagacgcaatagttatgaaacaggcacataataaaaatahtaatacratgtatatagactacagaaaagcatttgattcagttccacacagttggttactatatattttaaaaaagtacaagattcaccccattctaataacatttttaagctccgtyatgctctcatggaaaactagattaaaattgattaacaataatgaaacactgattactgattggattaaaatacaacgaggcatctttcaaggtgatgcgctgagtccattatggttctgtctagcgttaaaccctctctctgaattgcttaataataccaatacaggatttaaactaaaacataataacacatatcatataatttcacatttaatgtacatggacgatatcaaactatacgccagtaataataaagaactaaaaatactagccgacctcacacaatccttctctacagacatacgcatggaatttggaattgaaaaatgcaaggtacattcaattaaacgtggcaaatcacaacaaaatacatatatacttaacactggtgaacaaattgaatcaatggacgaaaatagcacgtataaataccttggatttcaacaagctaagcaaatacaacaaaaacaaaccaagatagaactaaccaataaatttaaatttcgtttgaatcaaattttaagatcacaattaaactcacgtaatattataaaagccatcaacacatacgcaataccgatccttacttactcttttgctataataaactggtctcaaactgatttatcgaatctgcaacgtataataaatacacacatgactacacataggaaacatcaccctaaatcatgtatccagcgtctaactatatcacgtctggatggaggacgaggtctcattgatattcgtaacctacataataatctagtgactaaattccgaaattacttttacgctaaggctgaaattagtgaactacacaaattcatagttaatatagataataaatatacaccacttaatttaaacgatagaaatatacaactaaatcaaactttgataactaagcagcaaaaaatagaagcatggtctttaaagtcactacacggtagacatctagccgatcttagccaaactcacgtcgacaaagttgcgtcgaacgaatggctacgacggggagatctcttcccagagacggaagccttcatgatggctattcaggaccaagtaatagacactaggaactatcaaaaacacatcataaaaagaccaaatatggtaaacgatttatgcagaagatgctattctagtcctgaaacaatccaacacattaccggagcctgtaaaaccatagtacaaaccgattacaaacatagacatgatcaggtcgctgcaattattcatcaacacctagcatttaaacattctctcatcacacaagcacaaaaaactccctattacaaatattcacctcaggctattttagaatctacaaattttaagctgtattgggatcgtacaatcatcacagataaaaccgtacactacaatagaccggatattttacttcatgataaagtwaaaawttctgtatacttgatagacatagccattccaaatacacacaatcttgcatccactttttcaaacaaaatagataagtatacagatttaaccatagagctcaaaagtcaatggaaagtccaatccgtcactacagtaccaatagttctttcaacaaccggagtagtacctcatacgctacacacgagtctggaaactttgggtattcaccggttaagttatattcttttacagaaagccgcaatcttaaatacatgccgtatagttaggaagtttttatcatcaaataattaacttattgtcagaattccttactagtaataataattatcgctgaaaatctccacccaaatattgcttggctatatgctcgcaatttttggttaacgtaccccaatgatttgggagaacaaaaatggtaaaactataataataataattatattaatat

SEQ ID NO: 1139 - DNA, 3621 bp, Takifugu rubripes
  modified_base (459)..(459): a, c, t, g, unknown or other
  modified_base (520)..(520): a, c, t, g, unknown or other
  modified_base (935)..(935): a, c, t, g, unknown or other
  modified_base (1080)..(1080): a, c, t, g, unknown or other
  modified_base (1190)..(1190): a, c, t, g, unknown or other
  modified_base (2793)..(2793): a, c, t, g, unknown or other
ttctatgcgccttatgcgactggataggccagtggtttacgccgctgactttggtgcggaaggttgtcggttcgaatccaggcgagcccttaggcaaggctccttacgcatatatgcctacacctcggtatgagcggaacmwtaactgatagagtcataccggctcggacgtcgcccgggtcaacaaggtccgcgtcaggggtcggggaaccagggccacctgatgtcaaattggctactggaacaaggcattcatggagcagggcagagaacgtggtactgatggagtgttactacgggagtaaccccagcgagagagggtacatgcagaggatgtgggagaaatgggtgcttcgaaaccccacatcctcactgactaagaagcagctcttagctcagtgttcgaatatccgcaataagaagctgctatcacagctagagattgacgaggcacggcgntgtgcctcacccacggtacaaatatgctacggcaagggggagccaggacgccaggtcagcntgggggtgatttcatcatcaccccccaatatcgagattgggtacaaagccccaatgacagacggactcggcacaagggcagctgacctgagagagagaatcatgaagtcctgggggaactcaactacctccctgccaaggctaacacacaaagtaccagaccaatctctactggaggacatgaacacggcactgtcaaccatccctaccactaccatcactgagaccaatcagctgatgtatgcagcggcaacagtaatcctacagatgcttggctataagatgaagagcatgaacagccagaaggagcaaatggccccatggaggagaaggctagaggcaaaaatcatggcgacacggagagaagtcagccttctaacagagctgagtagaggcgtgaatctaaggacagagcngcccaagaaatataacaaactgtccacaactgaggcactggagactgctaagcaaaggctcacagccctggctacccgactaaagaggtacacaagagaagtagaggcaaggagaataaacaaggtgttctccaccaatccagcnaaggtctactctcaatggcagggcaacaagatgacaacagacccccccagggctgagactgagcaatactggaagagtatctgggagaaagaggcaacgcacaacactantgcccaatggctgcaagacctacagacagagcacagccaacttccagaacaagacccagtagtcatcaccttagcagacatccaaacaagagtgtccaaaatgaagagctggacagcaccagggcccgataagatccacgcctactggcttaagaagctgactgcactccatgaacgcctggcagcacagatgaaccagctgctaacatcagggaaccacccagagtggctaacccagggccggacagtcctcataatgaaggacccccagaagggcacaataccatccaactaccggcccataacctgcctcagcaccacatggaagctcctatcaggcatcatagcggctaagatcagtaggcacatggatcaatacatgagcagagcacagaaaggcataggcaacaacaccagaggtgccaagcaccagctactggtcgacagggcaatcgcccaggactgtaggacgcggcacaccaacctgtgcactgcctggattgattacaagaaagcctatgactcaatgccgcacacatggatactggagtgcctaaagctgtataacatcaacaggacactaagagagttcatccagaactccatgaagctgtggaacacgactctggaggccaactcaaagccaattgcgcgggtgagcatcagatgcggcatatatcaaggagatgccctgtcccccctgctgttctgcataggcctaaaccccctcagccagatcatcacaaagagtggctatgggtaccagttccgaagtggaacaaccgtcagccacctcctctacatggatgacatcaagctgtatgccaagaacgagcgtgacatcgactccctgattcacctcactaggatctacagcaaagacatcgggatgtcattcggactagataaatgtgggcggatgatatctagaagaggaaaggtgatcgcaactgatggggttgaactacctgaagggaacatcacagatgtgcaggacagttacaaatacctggggatcccgcaggcaaatggtaaccatgaggaggcagctaggaggtcagccacagccaaatacctacagaggttaaggcaggtcctgaaaagtcagctgaatggtaagaataagatccaggccataaacacctacgccctgccagtaatcagataccctgctggcataataccctggccactggaagagatacaagccactgacatcaagacaaggaagctgaatggtaagcataagatccaggccataaacacctacgccctgccagtaatcagataccctgctggcataataccctggccactggaagagatacaagccactgacatcaagacaaggaagctcctcaccatgcacggagggtttcaccctaagtccagcgtcctgaggctgtacacgaagcgaaaggaagggggccgaggactagtaagtgtccgaactactgtccaggaggaaacaacaagcctccgagaatacatcaagaagatggcccccactgaccgactgctgagtgaatgcctcaggcaacaaaagcccaccaaggaggaggagcctgaggggctatcatggaaggacaagcccctgcatggnatgtaccaccgacaaattgaggaagtggctgatatcgagaaaacataccagtggctggaaaaggccggactgaaagacagcacagaggcactactcatggctgcacaagaacaggccctgagcaccagagcaatagaggccagggtctaccataccagacaagaccccaggtgcaggctgtgtggagacgcccctgagacagtccagcacatcacagcagggtgcaagatgttggcaggcaaggcatacatggagcggcataaccaggtggctggcatagtgtacaggaacatctgcactgagtatggactggaggtcccagggtccaggtgggagacacccccgaaagtgctggagaacaagcaggccaagatcctgtgggacttccagatccagactgacaagatggtggtggccaaccagcctgacatagtggtggtggataaacaccagaagacagtggtggtgatagatgtagcaatcccaagtgatagcaacatcaggaagaaggaacacgagaagctggagaagtaccaagggctgaaggaggagatggagagaatgtggggcatgaaggcaacagtggtcccagtagtgattgggacactaggggcagtaacacccaagctgagtagatggctccaacagataccaggaaccacatcagagatctctgtccagaagagcgcagtcctaggaacagctaagatcctgcgcagaaccctcagactcccaggcctctggtagaggacccgagtctgaaggaaggaggcaccgcccaggagggcgaggaagagatttttttttatatatatatatatatatata

SEQ ID NO: 1140 - DNA, 175 bp, Taeniopygia guttata
gtctagttacaactgggcatcgctgcagagatcgcacctcctcgtggtcccgctggtagcccttcgaagggtgactaagtcgatctctgccccaggtacggagccgttgggactcaccagtccaacgtaactcctgcctaaattcggtgaaacaaattcctcggtaaaaagcccc

SEQ ID NO: 1141 - DNA, 91 bp, Geospiza fortis
agacttaagtgagtttggttacaactgggcatagctgcagagaccgcgcctcctcgcggccccgctggtaagcccttaacagggtgactaa

SEQ ID NO: 1142 - DNA, 160 bp, Zonotrichia albicollis
cgacttgagaaggtctggttacaactgggcatagctgcagagatcgcgcctcctcgtggccccgctggtaagcccttaacagggtgactaagtcgatctctgccccagtccaggagccgctgggtttcaccagcccagcgattccttccaaattcggtga

SEQ ID NO: 1143 - DNA, 152 bp, Danio rerio
aatcccccctacccaatccccccgtcgtgacctccaggccaggaatcacgagcgtacgacagtggccatccggcaatgacaatagcgtgactaacgacaatgagtcagatccatgacccttggagtgggttaacctccgcctctttaaaaac

SEQ ID NO: 1144 - DNA, 500 bp, Gasterosteus aculeatus
catattggggtctcaggaggagacacagggtctgttgcggctccggtaaacggtaccggagtcggttaagcatcgtttgggcccgcctccacgtggtggtccgcggtaacaccaatagggtggctaagaggcccagtaatttccccgaattgtcttcccccccgcgcgggggggacccccctttagtgtcggagcggtcgcgcctccgcgtttggggtgtcgcaggcgtgagccttcgtccccttaagttcagacggtcccggcttcttgccgggccaacccccggtgcagcgttctcccatgttggatcggcacccagccccgggtgccatgcgagttcagacattttgtttatgtatcgtctgcgtggttgacttgctaagctcatttcctcctctcactgcgtccccccaggtgctgatcggttgaagaggattcgtcgttgacctcggcggtgaatttgggattgtattatacaggtaggtatagagggcgtgcgg

SEQ ID NO: 1145 - DNA, 595 bp, Bombyx mori
gggcgatacgcataattttaatttcccgattgaaatccagtcgtcttaatctggtgaccagtggcgcggtcaccagtatagtgcacaggacgtgaatggctccgaggctggcggagtcactcactataagtgtgagagacgatgtcctgtgccaagtatacgtccaaccctaacgggttaagtgaaattagttgctcataacagggacggtgtacctgtttgctcgtggctggctatcgaatggacgggaccaatacacccccctgttagtaatggggtaagagagagcggtctgaaactatggccgaaatcacgacgccccactcctacccataacctgcacgtggtaccgccgcacattgaccgatacgggaggaggggcagcacttgaatcacgtagtcttggtgtagccattgcgggactacagccctcgtaagtgccgccttagaacgcaacggggcaataggtgggccggggcgctagcgggggggagtaatctcccctgttggcgtgcaccgcactgctcccactgggggcagtgtcatccggaaacaggtgggccggggcgccaccaggggggagcaatccctcctg

SEQ ID NO: 1146 - DNA, 337 bp, Hydra vulgaris
ttcaagtggatgaagctgggaaggtaatctgtagttggttgagttggttgcagattactgctgtcgattttgctttctattgaaagcctgtctctacgggtcctgaagcttgaattttggtagctatagttttgtgggaggaaagtggaattttgtaccatcttttgtctctcgtatctactatagtaaatccggtcatgcagcctctacgcggcgcaactagaaacttggatcagtgatcaaggctaatgcatgccgggtctcctcagattaggagtataatacaaatctgacttcatcactaagaggctatggggctaacgatcctatagtctcg

SEQ ID NO: 1147 - DNA, 265 bp, Hydra vulgaris
cttggggtcactgacacatttttcggtagccatagttttttgagaggaagagtggaagtttttccatgagtcgtctctcgtataaactgtggtaaatccggccatccagcctctacgcggcgcaactagaaacttggatcagtgatcaaggctaatggatgacgggactccatggataaggagatataaagatcttatttgaacgcatcttaaggggttatggggctaacacccccttaattctggtgcacatttattgaccgtt

SEQ ID NO: 1148 - DNA, 569 bp, Adineta vaga
gaaatagtttgcaatggtaggtgtatggcgcctctgtgtctctctttcgctggatatagtttgacgattttgtaccaggtatctgtttcttgtgagttcagcaccagtttgaacaggcttagcgatagaccttcgaacttgaaacactgttgtgaagctggctgggcccctgcagattttctcgattagaacgtgagtgttacgtccagaatgacccaccagtggttagttctacgttgccctggaaaggagaaaagttgagctaaaatcgcacggcctagttgtttatcaaataggcacggtgaggaactcttctatgtaccctgactaaagtactcacttgtgcgctgggtttgctccccctcgcattgacttatctgatcgcactacccaccaaacgaaacataaacttagctcgtggtatcagtccacagcgtgtgcagtcggattcaggggagcgtgttagtgacaagcaggataatattaacatagttaatgttaaggcgttcaacattccttatccaattggaagagttgactgtgaagtttgtcatgaagacattggacaa

SEQ ID NO: 1149 - DNA, 265 bp, Oryzias latipes
cgcacaggggacacagagcctgcccaagtaccgctcccgagggagcgggaaacgggggggtgactatcccctggggtccggcgagagcgctggtctacggaccaggggtggctgtgggcaggctgctcctcaggccagttgattagttacgcatgggctgtacctccacgtggtcccgctggtaacgacttgtcggctaaatcagcccgcccaccatctgggatatggttgaccgtctaaccccagtactcaggtcacaaacaaa

SEQ ID NO: 1150 - DNA, 840 bp, Limulus polyphemus
tgggaggagacccaaactatcctaggatggggcggaaccgaccatatgagccatattaacattgcccacactatcctctggaggtacctcctcgtggtacggctggatataggtaaatcctgtaaccaaatcctccaacccgtgaaggagaacactaaaacccatatagtggcctcgccaaccactatatgtccaacggcaggagaagctatctcccggatgggaaggaaaaccctaaaccgtgatgggaacttaccggccccatcagctattgggtacccggtagggacttgcaaccctaccctgtatttgcattttatagggaaccggtcggccctatatcagagtagaccgtttattaaatatgggtgaaaatattaacagtaaaagctatggtttggcgtccgtgtggtgccagggcggcggccaaacccgagctacttggcaccaactggggatggtagcttccgagcgattccctggcgacgtgggaccgatcgacgatggagtccaaacatccggaatagaggaattgagaaatacctattccaccaccggctcacatacccaaggtgaacccggtgcaactagagtacaacctatctgtggcggtaggtgccgaaccactcaggtgacgggcttgtttattgatgtctccctacgagacacgaattgtgacaaatccactccggtggacaattacccgatctatgaacctgttaccgatattagacaagaaaataaagaactgacaacgcctagagcttcaggcagcatgtctgtaagtatccagtcatcgagcgtgactgagggcgaaattgataataactctgaaactga

SEQ ID NO: 1151 - DNA, 394 bp, Caenorhabditis elegans
gctcactttctatcgtgttaaccgtacgtttacactcccagtgagtgtaataaaggttattcgatagagggtgtctccctctttcttgggtaattcttcggcggtccggggtctctccctcgtcttttttttaaacttttctttctcatccactcttttgctcctttttactaactcttgtactctatagtcttttctcatcccccatccgccgttgggcaaagtttatttactttgttaaatccatattttatctctctcacccgtacagaaagcgtctccttctcaaacgcttttctgtactttttcttatattttcattaacatatttttcctgtttatactaacctaacctccattgtcaattactaactaacttgtacaacggatttcg

SEQ ID NO: 1152 - DNA, 69 bp, Cryptococcus neoformans
ccctcttaataccccataacacataacaaccccctaatcaacgttctctgcaccttaaacaccaccaac

SEQ ID NO: 1153 - DNA, 102 bp, Chondrus crispus
acgccccctatccatttctgccagcctcccatcggctcgccgtctccgcaacccctcttcctcggctgtaccagttccgctcccacaacctccctcgccaca

SEQ ID NO: 1154 - DNA, 74 bp, Chondrus crispus
  modified_base (2)..(2): a, c, t, g, unknown or other
cnccagccamcgatcccgccgccactcgcmgcccggccgtctcgaccgccacctccccgasgccccagcccatc

SEQ ID NO: 1155 - DNA, 714 bp, Acanthamoeba castellanii
taaccctaaccctctccctcggcccctctaccctaaagcgccctaatcgaccggcgacgccctaatcgctaccctctacgccctaatcgactttggcgccaaagcgactttccccggccgattttcttcctgcctttttcttttctctccaagcgacgcgccttttactttgccgccgttctgttttttcttttctctttgcacttcgcttctacttcacacctcctcctcctccttctcgacccgcgcggcctcgagcgacttgctgcagcggctcccggcctcccccacgcggcctgctactcccgctttctagacgcccccggtcttgctctcagtctcccgcatcgaagcggtagtcggggtacgtgctcaagtgactcaagcctcttttcagcctcggcgctctctcaatccgcctcagtcttagcctttcaagttgctcgattacgctctcgaatcgctctctctctcagtctcagtctcagtctcaatctcgatcttgccttcgccttcgtctcgacgccttgctctcgwaatcgctgccactacgtgccagctttttcgtgccttgtcttcgtgtcgacccggaccgtttgcaagccctcgccttcgtaccccgctctcgtagccgttctcatcgctgaagcgttctacgcgctggcagcaagcctcggccctagcttgtagcgccgccggtggccgctcgccaac

SEQ ID NO: 1156 - DNA, 200 bp, Fragilariopsis cylindrus
atcaatctaatactgaaggcaataccaaactcaacccgaaatcaaaatcgttagaatcaatatacgacccccgctgctgtacatgtccagccggatctcgttgtaaagaagattgcagctgtaaaaaagttggacttctttgttcttcctgtgaagaagttgattgtggctgttcaaattcttttcataataaagaatta

SEQ ID NO: 1157 - DNA, 832 bp, Hydra vulgaris
tttctaatgttacgtgatatgatatggttagttcatggttagtttatgtttatgcttagtttatggaaaatcgtttatttatggcacaatattgtttgctgtttttaaatttatgtaacgtgtgcatttgatgtatattcttgaactttttaatctgaatttttacttggtttaatacgtttattatattcttcgattgagcaatttatcctatcaaagcaatttatccttcgattcgagcaatttatccttcgattcgagcaatttatccttcgattgagcaatttatcctatcaaaattagcatatatactgcaattttcaaataatctacgaaataagttcacttactgaaaatcattaagtaaaagaagaaaggaagaaaaaataaaaataaaaagtagtaaatcctttcataacaataatcattctattattaaatttaaaggaatattttggttttgtactaaatcatgcgttcatatttcaccgaagaagggggctgctatatttttgtttgaagttgtttatcttaaaactttaaacttgtgttcaaccaaccgtaaacattagttcgctgttcgctcaaattatctacaatataaaatttatcaatcttttttcgttacggtaaacaataaacaataaaataactatagttattttattgtttaccgcatattgtttaactatagttaaacaaagtatttgtttatggaacattaccagtatctcttgttaaggtaaacaacaaaacatagacggcatctctttttaaggtaattaagtatacggctaataataaaaatatacagctaataataaaatcttca

SEQ ID NO: 1158 - DNA, 258 bp, Lactuca sativa
acattaaattagagaggttgatgtttcaatggaagaagatgaaattccaagaagctatttttgttgcccaccaagtgtttgataaaatgtccaaactaatttttctcttgttgcagctttattgttcaagataatgtagtttgcttagtttgagcgttccttgtgcacaccaacagtgtgttggtgtgccatttcctttccttcctttttaactattgcttcatagcttaagcttcatctcgaggcttgttctcttgt

SEQ ID NO: 1159 - DNA, 122 bp, Monosiga brevicollis
catcttggcgtgaaccacgttgtcagacaaaatctgcaaccccgctctttgcggcccgcgttttggcggcgccctcgctcccaccgtgtccgctcgcttgctcgcttgcttgccccgcggac

SEQ ID NO: 1160 - DNA, 453 bp, Hydra vulgaris
aatttaaaaaaaaaaaatcgtttatttatggcataatactgtttgtaatttttgaaaattcgtgcaacaactgcagttaaattgaagagctgaaatttaagatctgagcttttcaatcagagttttttaccctaaaacattaaattttatcataacaaaaatcgttctaatattattaaacttaaagaaattcgttcttatatcaaatcttatttcagtgtttcacagacgaagggttttactagatttttattttttcaacttttgaatttgtttattataaaactgtaaactagtgtgcaaccaaccgtaaaaawtagttagctgttcacccaaaatattattcagtatgaaaatatttaatcttctttattcgcagtaaacaataaaatatctagttaaacaaaatatttcttaataataaaaaacaaaaactttttcttaacaagtaca

SEQ ID NO: 1161 - DNA, 1461 bp, Magnaporthe oryzae
cccgaacccgaacccaaacccaaacccaaacccaaacccaaacccaaacccaaacccaaacccggagggttcccaagtcgcctaaacccgaagggtttaggatattatttcgtttattagaattggataattatttacccctgttggacaggggggttgcaggggttaaattaaggttttttattatttatgcgccgtttatttgtttacccccccaaatattataaaagcgcgttccatcctcttaggaaaagcgaagcttttccttgtaaaagtcgctagacttttactataaaagtcgctagacttttataccaatcttttaacaaaaagcgtagctttttgttgccaatctattaaaaaaagcggagctttttttaactttttcttttttttttttttttcttttttttttttttttttcttttttttttttttttttttttatatatattattattattattattagcggtggggctatttatgcgctttaatttgtgcggggctatttatgcgctttaatttgtgcggggctattaatgcgctttaactttacaaattttatttatgcgctttaattgctgcgggcctgttaatgcgctttaatttacaaatttcattaatgcgctttaacttttatatttactaatgcgttatttatataattgctattattatcgttgctattattattattgctattattatcgttattattattgcaattttattatataaaccctcgtttgtccctcgatttatcccgtttcttttccatcccatcgcgcgttttcgtaagctttggttttcgtaggatttgctttcgtaggctttgctttcgtaggctttcgtcagcttttacctgcttttattttttctttttctttttattccccccccttttttttacctggtttattagcggtttacctgcttttattacctggttcccctttacctgttttattagcggtttacctgcttttattacctggttcccctttacctactttataagcggtttacctgcttttattacctggttcccctttacctgttttattagcggtttacctgcttttattacctggttcccctttacctgttttattagcggtttaccagcttttattacctggttcccctttacctactttattagcggtttacccgtttctattagtgggcatttatttcccgtttttattagcagttaaatttacccttttaaggttatttacctgcttttattcacagggcacccctgtttttactagcagttaaatttacctttttaaggttatttacctgcttttattcacagggcacccctgtttttaccagcagttaaatttacctttttaaggttatttacctgcttttattaacaaccctttattttttcctattaacgggtatttatttacctgttttattggaattcacccgttggacggc

SEQ ID NO: 1162 - DNA, 278 bp, Branchiostoma floridae
ttttcagtctggctcagccagtgaccgccgggaaagtccggctgactaccacgaatagggtggtgacagctggatagacagacgacagctcggaaagacggcattggggcagtatgggttggcacccctaactgcatctcccctaggagagcatcccgcaacacgctacaaagaaccacaaagagcaatacccccagggatgcccgagagggggggaggatgagcatcccattcggacggtccaatcggtattgaccccagcaaacggagaatcgaca

SEQ ID NO: 1163 - DNA, 251 bp, Danio rerio
ttcaagcctggcgcagccagtgactcctaggaatagactaggtggcaaccaagaatagtttggtcgactactggagagacagttgacggcacggaaagacggcacttgggacagtatgggttagcaccccagcctgtgtctttcgtgagagagaacccaaacaagctacggaaagccccacagagatatacccccaggagatcccgagagggggggaggatgagatctccaatcggacggatcaaaggtta

SEQ ID NO: 1164 - DNA, 214 bp, Branchiostoma floridae
ctgaccagcagacgggaagcccgcgaccaactagtctccgcaaatattgcacacagggcgaccctatggagctgattcagtcaaatttcctctgagatataccgataactatctacagaaactgcacagttagtttggaaagagcttttctactgaaagacagcaaaatccgccactttagacgagcgtcaagactgccctccccataaccaat

SEQ ID NO: 1165 - DNA, 12 bp, Danio rerio
aaagcagtagag

SEQ ID NO: 1166 - DNA, 217 bp, Takifugu rubripes
agactaggtgacaaccaagaacagttwggtcgactactggaaagacagttggcagctcggaaagacggcacccgggacagtatgggttagcaccccagcctgtatctttcgcgagaaggaacccaaacaagctacggaaagccctacagagaaacacccccaggagatcccgagagggggggaggatgagatctccaatcggacggacctaacgtta

SEQ ID NO: 1167 - DNA, 247 bp, Tetraodon nigroviridis
agattggtctggctaagccagtgacgtccaggaacagactggctgacgaccacgaatagagtggtgacagcttggatagacagctgacagcagggaaagacggcaaccggggcaggaagggctagcaacccagcctgcatcttccgtgaggaagaacccaaaacttgctacgaagagcccgaagcaaagatacccccaggggagcccgagagggggggagaatgagctccccaaacggacggataac

SEQ ID NO: 1168 - DNA, 227 bp, Schmidtea mediterranea
aaacgacatcatgaacgcttggccgcaacaatccagttatccctgcggtaacattgtggaactcataagacaagtactaaaagaagaattagaaaaattagaagaaaaaattgaaaataatttatttataaaatttaaaaatttaaataaatttaaaaatttaaatttaaatttaaatgaagataaaaatttatttaatccaataaataatcaagaaaatcaagaaa

SEQ ID NO: 1169 - DNA, 74 bp, Caenorhabditis brenneri
aaggacgctggtttaaggccgaattcgttcgttctttttctggcggtcttgctttgagcttggtttccgatcct

SEQ ID NO: 1170 - DNA, 815 bp, Caenorhabditis japonica
gcgccccgggttacattgtcggggccacctttctcttggagtagagtacagtctactaattttttgataagctagtcgggtccgaaccactagagtttgcttgaaaatgcgtcaaaccagcattttagaactcgcccaaaagttcggccccgacccccaaacaaatgggaccttcttgacgattttccctgaaaatcggaggatggaatggtcccctattcttgtaaatagkactgtgcaataccccttcgtcatctgtggggaacagatgacacgtgacgtcatccgtgtagacgtcacgttttcccgtgcctgcgggagcccccaatcgagcaatttttgctcttttgagtgtctggaacgcttgaaaccccagacaaatcaggcccagtcgtcggaaaatttctttttgaaattttttggcgcctgcgaaaaaaattttttaaccgccacaaacccccgggaggcgcggwtagggatatcgatgtcatcgactcgtcggtgatctttgattttctctctgcgtctcctattttggaacagtctcgaccaaaaaaccgggcctggcaacccaccgaatccggatgtcggagggatttggcaagaaatgttggaaataacgaaatttcgttattttcagcacaattgtcaaaccggcaagaaaactggatggacaagacacacaatttaccggaaattgtgcttgttacgtcgaatttcccaattttgaaaaaattcctcgttccactggtcgggacgcgaggtcagacgatctgcacgtctgaaacccaaaatcttcggattttatgcagtag

SEQ ID NO: 1171 - DNA, 14 bp, Caenorhabditis remanei
cgcgaaccagtcat

SEQ ID NO: 1172 - DNA, 19 bp, Trichomonas vaginalis
gggtgagtagtctagtggt

SEQ ID NO: 1173 - DNA, 389 bp, Caenorhabditis brenneri
gactcgccttggggaaggtwtttcaggggksaattgccgmaggcaaggcagcccccsmmtagcttacaaagtaagtacmcattttcatttcttgtgaattctttaaacatatttttcttgttttttgatttcttttttctctaccttcccccaattcttcccctcatcttgtgtatacatccccctcctccaaccaatcaatacattgacctctctcttctgtcaaaaaatcaatactagtatattgtcccttgtatagtattatttgacgtcgtctttgtattaggagtaggtaacaawctgtgtatggcttcaaaaagcatgcacaaacwcctgtcaaaaagtawttcccatcmtgtgaatagctcaacgacwkgaagmccaatgat

SEQ ID NO: 1174 - DNA, 839 bp, Caenorhabditis remanei
ccaactctcatcgtattaacctacggtattcactcctagtgagtgtaataaaggttaattacgttttctcttgcmagagaaaaagaaaattcgaatcctttttgtgtaactcacaaactgacagagacctatcgaatttcctttgtttcgtatataggaatagtcactctggaccacgaagtggacagttgtcggcggacttccagagtggagagaaaaggtgtgaagagaggaggtctagaaacacttcggctgtctaggaccagttcctgagtggaaagaggaaggtctagaaacacttcggctgtctaggaccagttcgtgagatctctcgtggagagttgaaaacagtcagctgaggctactgtatttcttgatagccccgcccccaatccccctcccccccccctcgacagatttttctgtttgacctcctggaatttgcgaggagtgcgcgagaattttcgaattcttcgcgcgttttctcgaaattttccagaagattcgagcggagaatcttcgagaaagtgagctgaatttcgcgcgaattttccgcgattttcaaattatcgatttttgtcggaaaatttattttctggcaaaatttgattgagttcacgcgggagagaaggaattgttggaaaagggtattgatttttgtggcggaggaaactcccactgaatcaataactctcaaaggagaactcatcgaacaacctcgggtgacctgaatcttgggcgaaattttcgcattgacacaagataamacaaattactgtkgaaaataaatcagaacaaactgtcaaaaagagagacaaaaagtattgattaacaacatc

SEQ ID NO: 1175 - DNA, 320 bp, Caenorhabditis remanei
cccttttctatcgtattaactacgataaccgctcatttgagtgtaaaaaaggttcccccctcctcgcctgccttacccacgcatctctgcctctgggaaggcggagggtcaacttgcgggtctgtggatttcctttcctatccaccgcccatattctctgtcgaaagcctacctagatcagccgggagtttttcctatcccattcaggcgatcgctcaaggctgttttatcgacactccttcttgacaagtatttatttcttgacaaattctatttttccttttatcgattttctcttatttatcgattcttgtgaaaat

SEQ ID NO: 1176 - DNA, 992 bp, Schmidtea mediterranea
ttaaatcatttttaaatgtgtttgaatatcttaaattatcaaatcatattaatatcaatgctaaaaaaaaatcgtgckcatcaggcgcacgaaaataatggacacaactcgtcgacctgctgtcgactcacagagaacctcaatttggaagaatgggaagcctataatgctacaattccgccaacccctatttgaatgacagatagtcaaatatcaaaaaatatacaaactgctgtcaagcgtgactcacttccttccaatcgaaaaataggaakatgtaagaaacatgaaagtcaagctgaaaaaccaataatatgtcctaaaataaaacaatttgaaaatatgcaaaaaatacctataaaatcacagccgaataaattcccatccgttctaagcagaaaccgctacgaactactgcaagaatcggatcaagtatattaatttccccccmgggggaaattaatatacttgttakaaaattaattttttaataaaaataaataaatcgaataaatataaaataaaaataaatcaaattaaacttttattaacaataaaatcgcagtaagtaaatttccactgttattaaatttaaaacaaaattcctttaaaaatgcctctctttttcagtaataacaccttttcttgcttttattactatttcttgtgtactgtacaaatcgagcacagttattgcaaataggacatagaaattcctttttaagtaaatttaaatccatgagaaataaaataaaatccttttgattcaaagtttctatgttgctttctaatagaatggtgtaagcattaatgggtcttgatttttataaattaaatatatttaatctattaaattaatatgtttttattaattattaatttttatagtggggggaaattaatatacttgatcccaagaatcaactgatgatgaagaatatgttatttcaaaatacatacaagaagctggaaaaaacaaatcaatcgctaca

SEQ ID NO: 1177 - DNA, 1123 bp, Girardia tigrina
gtaggtaactatgactgcaaaataataattctacacctattgttgataactcatctcgtgcgcaaacggagcatgttatttctaatcatttcgtcacacaggattcttctaattctgatagtaatattatagatagagataggaaccttgttgatttagatgcgtcaataacttctcctactattatacagccagaggatagtaagatatctgaggatgaggacttcatcttagtcaataggaaaaagagcaaaaataagaaaaaatctaagaaaacaactgaaaataaaaatgaaattcctattcaaaagagtaaagataagaaaaagaagtctaaaattaataccgaaaaactaactgaaaatattactacttctgaaataccacttgaaattgctccttccatacctttaccttcagcaagtacctcgggttctcaacaaccggccaatcctccagaagacgctactctaagtgatacggatctcttccttacacaggatgatcccgatagtcttattctttctggaagtactcaaccaacctttgttgacctcaacccttcacagcaatcggaacttccttcaaatactgacagccaaagatttgaggcgggtgaaacacccaaaatcataacttcttacagggatgaccttttctactctacagtccttcactacaactcagatacaggttacggtataagtgttgacaatggggagcagaggtttcgaattcttgctaggaatcttgtcaggaaaaccaaggataagttcccctctttatatgctggacaagtaattagacacacagtcttcttcaatcacttcaaccaggcatactacgccaataatataactgatagtaaaggtaatctaattgagttttctgatgataagccttttcaaagtataccgactgacccaaaaactgaactagagcaaattaggagagagagacaacatctagttgatagagctcttagacataatcagttacgggaaacttatattttaaataaacttaataataataatggggggggtggcgaacatttgaaaaggaaaaagatcaaagtcaatacggatgatgtctccagcaatgatggagacagaaaacatag

SEQ ID NO: 1178 - DNA, 43 bp, Chrysemys picta
gtttaattccttctgatggacatctgcaacacccgtcctgaag

SEQ ID NO: 1179 - DNA, 107 bp, Acanthamoeba castellanii
cccgtcaagggtgctccacgagatccctgtcgctagccgaccggttttaccaccccaccccgcccggacaaccacggaccctgctccgcagcaggaccccacgcacg

SEQ ID NO: 1180 - DNA, 188 bp, Acromyrmex echinatior
ggtgcacaacggatgcatcatacgtgtaccggagcatacgggctgtcacggcggctgcatgcgcgatctagctcggagattttatttatttatttattaatttatttatttattcatcgagtgtgagtgttcgcgttttgccgagaagcgattttcgttaagtgatacgcgccgcgttcataggttag

SEQ ID NO: 1181 - DNA, 1264 bp, Alligator mississippiensis
tgctggaaagacggagaaccgcttcctttttccctgcgcctggcctggtattgcagtacctccaggattagcgccaactagtccggcagactgtcggaatacagcaatagaaagwgagctgactagcagcttgctttccttcctccggtgcagcatgggttctcgtcagtcmtgacgggctagggaaggcggtgctgccagtacgtccgaaagagtgccggttgcgcaagcgaccgcgccactcaggtgagtagccaagggtcttacagttcaccggacccgawaacgcgaaaaccccaactcgggctagtagccgaagacctgggtcccccccmggtcagagtaggcgaacgccwgkgctcagaggacggaacgcggaaaacacccccaggtcccaaggacgccctgatccactgacaagaacgctcgaggcacgccaggagacccccagctagggtggaccgccgactgcaggtccggaggaccctcccaggagggtggaccagcgaacccaagttggcgacgaaccctgacgcaccccccacgatgtcaggaccccgacaggcggcggtggaccactgaccatcgaccgacccccagaggcagagagactctcagagcccggaaccccggctgacgagagccgcctcccggcggaggaccccggagcctgaggatgccccccggatgacggcggagcgccccgagcgacagcggacccctccggacccccacggcccctcggtgacgatggcgggccccgaacgacgacgacccccggaccccggcggtcccgaggacgccccccccgagggtctccccacgctggtggaggagccccggacccccccgacaccggacccccccacggacgacccaggcgaaggcgtagacatgacagcactcacgttcctccccttccccctcccggcgaagctgttctgcccgacctgccacccgccaagacagtacaggtcgcacggcgacatgaacaagcacctacggcgcttccaccagctgcgcctagccttctactgcgccctctgcggcaccgagtacgaggccctgaagctcctgaagaaccaccagaagggatgcgagggccacggagccgagaggagacccggcacgctggtgaggtccgctgccccggcccgccggacccaggccgcggtgcgaaggcccgccagactggccaccccgccgacaaccccaccggaccagacctccagggaccacccgacggagagacctgccccagtga

SEQ ID NO: 1182 - DNA, 200 bp, Chelonia mydas
ctcttcttatgaatacttgcaacacctgcactgaagatggattctccggctgctatttttgaaaaactgatgctgctttgaaggtgtattctgctgctgctaccttggaaggaaattctctctctgctcctgagacatccccagctgcaccgtgtaccaccaccaccactgctgctgctccacagaaggtttctcggaca

SEQ ID NO: 1183 - DNA, 460 bp, Chrysemys picta
ttttttctgatgcttgactgcaaacacccatccagaagatggaatctcctgcagccatttttgaaaaaattgatgctgctttaaagatatactccattctcctwktttgkaagaaaactctttttcagcttcagctattctgtcatcggctgctgctgttcctgcttcccagaaagctcagcmaaaacctatcctgaagaccwcccttggtgcctcacggaagacccggascacctgcaagaaccaaaacattaggagctggctgaagaaaccccccgtggatacctcwgcagggagacctggstccagmaggacakctcttcgggacctcmcatcsaggagcaagaatatctcaacagctcttcaggagggggacccccggagaaccctgcccgcttcccagaaccaggatgctgatcgccgccccaccgggaaggatgccaccgcaggagccccccca

SEQ ID NO: 1184 - DNA, 380 bp, Drosophila yakuba
aaagtgtagttcttttctgttttagtgtagtgggaagtctgtttctttttattatgttttttacgaaaaagtcctggtctttgaaattcattgtctaaattttaaataaaattataaaatttaaaaagaaaattaattaaagaagcgatgaaatatctctgaaattcaatcaatcaattaatcatggcgtctcagcgagtgcacgtatttgcctaccccttcgtgggaccattccggtgctccgtatgcatggatgcgtccgggatgcatcccactaggtcgctgggcgaatacggcacatacgctgcggcatatcagcacataacccggcgccacccacaagtggttattacataccgttgccgggtctgtggcgctga

SEQ ID NO: 1185 - DNA, 557 bp, Gavialis gangeticus
  modified_base (325)..(325): a, c, t, g, unknown or other
  modified_base (444)..(444): a, c, t, g, unknown or other
cgctggaaagacggagaaccgcttctttttcctgcgcccggcctggtattgcacttcctccaggaccagcgccaacctagtccggcagactgccggaataatagcctcagaaagagagctggctagcagccctcttttctttcctccggtgcagcgtgggttcttgtcagtcctgatgggctagggaaggcggtgccgccagtacgtccgaaagagcgccggttgcgcgagcgaccgcgccgctcaggcgagtagcccaagggtcttacggttcgccggacccgataacgcgaaagccccgactcgggccagtagccgaagaccntgggcctccctccccaggtcggagtaggcgaacgcccgtgctcggaggacggaacgtggacaaaacacccccaggtcccaatgacgccctgatccactgacaagaacgctcgaggcacnccaggagacccccagctagggcagaccgccgaccacgggtcgcggaggaccctcccaggagggtggaccagcgaacccgagtcggcgacgaaccccgacgcaccccccccgcg

SEQ ID NO: 1186 - DNA, 10 bp, Lytechinus variegatus
atctactatc

SEQ ID NO: 1187 - DNA, 102 bp, Nasonia vitripennis
ccattccttcgtacgggttttcgtgccggcatagccgggtgggagactcgcgcgggggaggtcatatctcaccaccatcctcgagctttttgctgcacctga

SEQ ID NO: 1188 - DNA, 1097 bp, Phytophthora capsici
  modified_base (169)..(169): a, c, t, g, unknown or other
  modified_base (956)..(956): a, c, t, g, unknown or other
gcccgccggtggagtagccatgttggccaccaccgcccaagtctccgccgcagctgcgactgctgctgctcatcgagtcgcagtagtcgcagctgcacaagcaccacctcctgccggacgcgccgccgtggagcaccacgcgcgcgctgagccgtaccaagaccaaggnttccaggctcgcgcgcgcgtggmgctcccagccagcgacgcgttcagcagcagggtcggctgcggcagctcgacgctgcacggggacggcagcgacggcaggcaccaagaccacgacgaccaagccgtcgctgccgtccccatggacgtcgaccaaggtgctcggtggccgacagcggatcamcacccgctgtcgccgccaccggagctccgagtcggcggcaagcgccgccgcctgaacgacggcgacgacgaagacatccgcgagctggccgagcttctgctgcccgacgaggaggaggccgacgaccacaaaccagcgcccaggttacccgcgaccagcgctcatccggcctccgtcctcgctgtgtacgcgcacaacgcgcagcgcttcaactgcacgttgtgcgtgtacacggctgccagcttcgctgctcttacgcgacacagggactctcggcaccggcgcgtgaccttcctggacaggttctcggcgggttgcgcgtgcggcaaaccttttgcctcgaggctggccgcagcaagacacgcacaaacgtgcgccagcctcagcaccacactggtcgcggtttcgacgacaggaggagcatcaagccacactgtcgtcggagccaacaccaccgtcgccacggcggtcaccgccgaaccccccctgctccaccatcaagcctcggaactcactgtgcccccccccacgtgtgagttcccccgacgtcgatgtgcagctgcacagtccgccacaggaagatcagcacgaggacgccacccancacccggagagcacgcaacaccaacctcctgaggcaacccgctggggttcgccgctcgcgcccacgctcgttgcctccaggattgctcagcgactcggcgagctggaacctccacgctggggcccaccattaccccgcgcg

SEQ ID NO: 1189 - DNA, 378 bp, Phytophthora infestans
agctcggcctcgcggctgccttcccaggcgccgccgacttcgcgctctggcgcggcccacacgccgccgccgagcctccaagcgcgcccgttggctttcgcagacgcagggctcgcggcgacggccctcgccagcccccaagaccccccctacgatgtggcaccacccggcagggcggccggcaggctgcccgactcggtatcgccgggtgctacactctcagccgccacagctcgggccttggcggtccgccattggcccttggagctcgacagcgacagcagcgacgacgaggacgctcaagacccccacgccgccgccccagaacccccagaagacgtcgcgagtgtgcttgccccacccggcagggcaggcagc

SEQ ID NO: 1190 - DNA, 142 bp, Patiria miniata
ctgatgtggataccttggaattactcaaccgtgtcggagtcttttgtcttttgcgcccaacacctcatggataccatgcttgtcgctggagcgacgttacaagcgtgagggcgccctccatgccggacagctggtctgtgcc

SEQ ID NO: 1191 - DNA, 291 bp, Phytophthora sojae
agacgagcaacgcgctggggcccaagacctggcacgaacgacactgcccaggctgtgaacgacgagcacgctgctaacccggcagcgcaccggcctctgggctccgctgcaccggttaccggtgcaacacggtggggtccacgtcacggcgcgatcggggcagcggctgtagctcgcctgctcacaggcctacccacggcaccagcaccagctacgcgccggcctgcttcggctcggcgctgcccagacccgcccgctccccccgcggccacgacgacagcccccgatgcg

SEQ ID NO: 1192 - DNA, 698 bp, Pythium ultimum
gcggtgtacgcgcacaacgccgcgctcttcgagtgcacgttgtgcgcgcacaccgcgcgggatctcgccgcgctccagcagcatcggcgctccgcgcaccgcagcgtccgctttgtggatcacttccacagcggatgcgcgtgcggcgtgagcttccactcgcgtgcggcggcaaccaagcacgcgcgcgaatgtccagagagcgcgttctcggtcgccgccgccgcgcgcactgcagcggccaacaccgcaggtatgtctctcggcgccgacgaacgcgaccacctcgcgtccgtcggcgccttgcatgatgttgcatcccccgcttttggcaacattttgccggttgcgtttgcgaccgcggcagacgcatcaagcgccaccgtgatcgcagacgcagccatgcagcacagtgctgtgccctctgctgccgcccaatcccctcggcgtgcgcacgtcccccccgtgccgcgcgccaccacgacaccatccgcgctgcggattggtggcaaacgccgccgcctgaacgacgacggcgacaacgaaaacagcgacggccgcgacgccgacatcgagatgcgcgccgacgacaccgacgcaccagcgccgaccaaccccgcgaccagtgcggctgcaacgcccgcgcgcacagcaccagcaccaacggatgccgcgaccgcgcgccgccgccacacgcg

SEQ ID NO: 1193 - DNA, 485 bp, Strigamia maritima
ggagtgttcttttcggagacgccgcctactttagaggagagaatccccacgggcatcctcatttgatctgatccatcgagtatctgcgaatagtcggcgcactccttttgccatgatcccgggggtctcatggtaaaaaggtttgtggcacggcttagttgacgcccctcttccacgtcactcggcctgcatcgatcgactgctctctcctcttcctccctccctcctcttcacgctctcttcacgtgaccccttcccatcccgcccctcggcttttggcaaagatctgtgtgtcctccaaagcacccatctaccatttgctcgagttgcgattggtcgaagctgccacgccactcgtctactctgcctctctgaccccttcccccctctctccctctgccgccctcgcctctcgggtcccttcccatctccctcctcccatccacgtgctccctcctctcgtcacgtgatcgttgcggctcgac

SEQ ID NO: 1194 - DNA, 1328 bp, Strongylocentrotus purpuratus
aaggctcaaaccaggctgccaaccaagctgccagcttaggcaccaaccaagctgccagtccaggctccaaccaggctgcccaccaatctgccagcttaggctccaaccaagctgcccacctagctgccagcttaggcaccaaccaagctgccagccgaggatccaaccaggctgcccacctagctgccagcttaggctccaaccaagccgccagcccaggctccaaccaggttgccacccgaaagtctgccagtttaggcaccaaccaagctgccagccgaggctccaaccaggctgccactcgaggctccaaccaggctttcacccgaagcattacccaggctgcccgtttaggcacaaaccaggctgccagccgaggctccaaccaagcaaccagcccaggttccaatcaagctgccagccgaggctccaagtaagctgccagccgaggctccaaccaggctgccactcgaggctccaaccaggctttcacccgaagcattacccaggctgcccgtttaggcacaaaccaagctgccagccgaggctccaaccaagcaaccagcccaggttccaatcaagctgccagccgaggctccaaccaagctgccagccgaggctccaaccaggctgcccaccaagctgccaacttaggctccaaccaagctgccagcccaggctccaaccaggttgccacccgaatctctgccagtttaggcaccaaccaagctgccagcctaggctccaaccaggctgccactcgaggctccaaccaggctttcacccgaagcatcacccaggctgcccttttaggcacaaatcaagctgccagccgaggctccaaccaagcaaccagcccaggttccaatgaagctaccagccgaggctccaaccaagctgtcagccgaggctccaaccaggctgcccaccaagctgccagcttaggtaccaaccaagctgccagcccaggctccaaccaggttgccacccgaaactctgccagtttaggcaccaaccaagctgccagccgaggctccaaccaggctgccactcgaggctccaaccaggctttcaccccaagcatcaaccaggctgcccgtttaggcacaaaccaagctgccagccgaggctccaaccaggcctccaaccaagctaccagccgaagctctgccagattaggcaccaaccaagctgccaccgttagaggcccagagcccaccaatcccataacgtgtgagatatgtgaagcttccttccacacctccgccggtctccgtcgccacacggccaggcttcatcgcaccactgctgaacacactgacgacagc

SEQ ID NO: 1195 - DNA, 232 bp, Trichinella spiralis
tttctggtatgaatcccaagcggattcgttacgaaatttgcataagtttttgaaaaaataggcatttggtcgagtgctcgcaccaccatttgtcgcgggtcgtcctgatattgcactacattcaggaacggcctattcccttcggggaattgtgttttaggaattggaatcggtttggttacgatcggtcgagtggttcgtgagatcgagtgacagccgggtggcagcgaca

SEQ ID NO: 1196 - DNA, 927 bp, Chelonia mydas
ggcagaaactgcacsttctagaagactcactgcctatcctgaggaagactaccgctttggagatggattctactgccgctgcttcaaaagaaaatcttcatgctgcttcggaggctccaggacagastgagaagatgatcgctccctcgccgattccacagaaaccttcaactgccgctcggaccgctgctgctccacggagcgcccatcggggaacagcctctaagagaccctcagcgcttccaggacatcgcagatgagcagcatcgattggaaaagcagcgcctccctgaagaaaacccgtggagatgctgctgcagggawatcttgcacctcgaggacggcctcccaggacatcgcagccaggacaaacatcatctcgcctgctcttcaggasaaggatgccmsaagaacttmtcccacctcctcmactgcccaggatcctsatgctggtcgtcgtcctgctgtgctggaagmkaccccaactggcgagacctcagaaaccacccagmwggacckcaacatctcactagatgcctgcccagccgaacctctccatgcwactctcccagagcaacsagaaccatccagmgaatccgctgatatgactgaagccmatccaacagagggagaaggaaaggagaatgactgcatctatctccagtatcccctccctacggacacgctcctctkccccttccgctatccgagggttccagtacattggcagtctcagcamacacctcaagagaatccatascaagcggatcaccttccggtgtgccctctscgacctgcctttcgagacgcagatgaaatgtaagtctcatcaagtcacctgcaaaggacatctcgaactggaagagtccaactttaccagtctatgttgccgccaccccatctctgctccgaaagcagaaacaccac

SEQ ID NO: 1197 - DNA, 840 bp, Phytophthora capsici
  modified_base (125)..(125): a, c, t, g, unknown or other
  modified_base (574)..(574): a, c, t, g, unknown or other
  modified_base (588)..(588): a, c, t, g, unknown or other
  modified_base (611)..(611): a, c, t, g, unknown or other
accgcccaagtctccaccgcagctgcgactgctgctgctcatcgagccgcagtagtcgcagctgtacaagcaccacctcctaccggacgcgccgtcgtggagcaccacgcgcgcgctgagccgcntcaagaccaagaattccaggctcgcgcgcgcgtggcgcttcaagatggcgacgcgaccagcaggagtggccgctctactgacggcggagacgaggccaagaccgaggacagcgacgcggacgcagccaagcgccaagccgctcaagcagcaccgagaccccatacccmggacaccgcgccgtacgacggccacagggactcggtgctggctgtgtacgcacacaacgcacctgcattcacctgcgcgttgtgtgtgtacacagcacgcaacttcgccgagctgaccaagcatcgccatgcagcgcatcgtcacacccgcttcgtggatcacttccacagcgggtgcacgtgtggcatcggcttccagtcgcgcgcggcagctacgcgacacgctcaagcctgtgcagacagcacacacgccaccgtagctgcctcgcgcgacccggcmnccastgcssccsgngccggmagcgasgaggaggaccncgcaccccccggtcctctsstcgcggcagcatctgcagctgcagcagccgcatcaagcgccactccagctgcagatactgccaccacgcagagcgccgtgcccatcgctactcctgggccccagtacgccccccacgtgctggagccacctccagagctccgagtttccggcaaacgccgmcgcctcaacacgccgatcgacctgcagccgctggacgtggacgcgctg

SEQ ID NO: 1198 - DNA, 377 bp, Phytophthora infestans
gctcggcctcgcggctgccttcccaggcgccgccgacttcgcgctctggcgcggcccacacgccgccgccgagcctccaagcgcgcccgttggcttccgcagacgcagggctcgcggcgacggccctcgccagcccccaagaccccccctacgatgtggcaccacccggcagggcggccggcaggctgcccgactcggtatcgccgggtgctacactctcagccgccacagctcgggccttggcggtccgccattggcccttggagctcgacagcgacagcagcgacgacgaggacgctcaagacccccacgccgccgccccaggaccccccgcagacgtcgcgagtgtgcttgccccacccggcaaggcaggcagc

SEQ ID NO: 1199 - DNA, 166 bp, Phytophthora ramorum
tcaagccccgccgccaagcccagctgcggctgttgccgcccctccagcagcagcagtcgcagctgaacctacagcccctcctgctgatcgcgccgccgtggagccccgcgcgcgcgccgagccgccccaagaacaagcacccccagctagcgcgcgcgtggagccc

SEQ ID NO: 1200 - DNA, 867 bp, Pythium ultimum
tgactggtgtttgatcacgatcaatgaggtgattaacatgagccggagcaggccccttacacgctggtgctgtaatggttcaggaatgctcttatgagtaactccacagtataatttttgttagcgggggtgagcgcgtgcgccgcccccacctttctcttttcgtttgtatttggttcctctggagcgacttccgtggcttttgtcgcgcgctatcgcgcccggcatgaggatcgtcgctcctgacgccatgtgcgccagtatatcggagccccgtgctccgcttgggtgtgtgttccgccacgacgccacgcgatttgcgtgcacggcatgcgctggcgacttccgctcagtgcgcgaactcgcggtgcatcgtcgacgtgcgcaccggtctctggccttccaggactggtatgagtcgtcgtgcgcgtgcagagcgctcttcaccgcccgtctcgacgcgttcgttcattcgagccgttgcgaccacaatgcgaaccaatcagcgaacgccgtcccctcgtccgccgcctcgacaacgagagcggacgcggatgcgacggccccccctcccgctatctctcttccgcggacgggcttcccccgcccctgtcctagttgcgccgctctccttctggatgcggcaacttggacgacccacgtgcacgcgtgcgctgccgccagtgcgacggcgttgatccagcgtcatctacacgccgttcctcccgtatcgacagcaaccgatctcaacggcgatgatagccaacctccagacccgcgtgccaacatccaacagcttccagccatccattcgacaacgacaacgacaacgacaacgacgacgacccgctgctcgacgacgtgctc

SEQ ID NO: 1201 - DNA, 56 bp, Phytophthora infestans
gtacggccgaatccctggcctctcagcctgtacgcggggctatacttggtctaagt

SEQ ID NO: 1202 - DNA, 568 bp, Phytophthora ramorum
tgcgcggcagaccaagacgcgcagccaacaacagaccgtgcagcgtgcgggtggaaagcgccgccgcctgaacgctggtgacgatgaagaccagcgagagctggccgagctcctgctcgtggacgaggacaaggctggcgccgaacaccccgcgctcaggctgcccacggccagcgctcatccggcctccgtcctctccgtgtacgcgcacgctgcaactcgcttcgactgcacgctgtgcacgtacacggctgccagcctcgcttcgctcaagcgccaccgctcgtctcggcaccgacgcacggccttcctcgacaagttcttggcgggctgcgcgtgcggcacgcccttcgcatcgaggttggccgcagccagacacgcgcaagcgtgcgccaacctctgcaccacctcggcgacgacttcgacggcagcaaaggcatcaagccccactgctgccggaggcagacccaccgtccgtgcagtggtcaccgccgcgcccgacctgccccgccagtatccctcggagctcgttgcgtcccccccgcagccgagctccaccaacgttgca

SEQ ID NO: 1203 - DNA, 378 bp, Phytophthora infestans
agctcggcctcgcggctgccttcccaggcgccgccgacttcgcgctctggcgcggcccacacgccgccgccgagcctccaagcgcgcccgttggctttcgcagacgcagggctcgcggcgacggccctcgccagcccccaagaccccccctacgatgtggcaccacccggcagggcggccggcaggctgcccgactcggtatcgccgggtgctacactctcagccgctacagctcgggccttggcggtccgctattggcccttggagctcgacggcgacagcagcgacgacgaggacgctcaagacccccacgccgccgccccagaacccccagaagacgtcgcgagtgtgcttgccccacccggcagggcaggcagc

SEQ ID NO: 1204 - DNA, 190 bp, Phytophthora ramorum
ccaggaatcacccccgccgcccccaagcgctccgccgccgagcccagctgcggctgctgccgccccactggtgacggcagtcgcagctgcccctgccacctctcctgttggccgcgccgccgtggagccccgcgcgcgcgccgagccgccccaagaacaagcacccccagctagcgcgcgcgtggagccc

SEQ ID NO: 1205 - DNA, 130 bp, Phytophthora infestans
ctcaagcctagcagcggctaccgcagctactccagctccggtagctgctactgctacaactgctcgcgctgctgctcgcgtcgccgtggagcaccacgcgcacgctgaaccgaaccaagaacatctaccg

SEQ ID NO: 1206 - DNA, 190 bp, Phytophthora ramorum
ccaggcatcacccccgccgcccccaagcgctccgccgccgagcgcagctgcggctgctgccgccccactggtgacggcagtcgcagctgcccctgccacctctcctgttggccgcgccgccgtggagccccgcgcgcgcgccgagccgccccaagaacaagcacccccagctagcgcgcgcgcggagccc

SEQ ID NO: 1207 - DNA, 1193 bp, Ciona intestinalis
atcaacccactactacaccctctacaaagaacccactacagcaagatcttggcgaccaactacacctgcagcctcccgtcgactcttcaccacctgcgcacctccctccgactccaagcggcagacagtggcaccaccagcactccaagggtccacagccagaagagtgcaccccccactgctaggaagagctaggccattgcccgctgtgggccttgtgctggctgtctgccgctgattggcacgttagggagtgtgcgctgagcacgatagggaggctgctgaagccgaagaacccgcgccggggactttaggactttaactaaaatctgtaacactaaaattggaatactggattactattggattactactggacaataacctgatctacaacaaccaattggattacagaaccaaattacaatctcaactacaaacaaaaagtgagtccccggccgggtttctatattacccaattactgtttttacaattttaaaattttatagtattttactaatttttccgccccgctagcacttaaattggcaccccccccccccstccaaaaaaaaatagataaccctccaccacctaaaccccggtcaccccctcagaactaattggaacccggatcttttccctctatcaaatttccggttcagtttggcttaattacctaaaacccgtctttattttatccctttattgccccttaaaccaaattattcaaattgaaatccggccaaattgccttgctgaaccaccatttttgtttttcttataaaagtaaatttttcaacaacccaaaatcataaaattaaaactgttatctgattagtctaaattctgttattgacaaaaacctccataccaaccttaatcttatcattatcttcacccagactgctcaatctagttcttttttcaatcaataaggaggtgttttctttggtctgttgttttatagtttaccgttataatagtctgttgtcctatagttttccgtggtgtatttctggtctactatagttggtgcctctaaaacattattataccgaagagtgctagcgatttctattattaactcacccaccagtactgctgtgcatccacgcagcaccacgcctgccatcacgtacagtgcgcttgctgccttgtgttttgttttgcagacaccactggacgatag

SEQ ID NO: 1208 - DNA, 360 bp, Schistosoma mansoni
  modified_base (137)..(137): a, c, t, g, unknown or other
atctcacgttttaatttatttttgaactactgcagtctgagtgcttctaacgacccgaaggctcagaaactacccacttcttgaactgctactttttgctgtttatccacaacaacagttgtgattctattctccanatattccttgtgcttttgtcaacattattctataccaactgtaccacctacttcttcatctcacgttttaattctggtcttattttctcatcattagtcacggagagggcctatgaacggtccgtgacgcgaaattctatccgcgatttcgacctctcctgctagtggtccccgaagtacggttcctctggcctgtcagttgtgttaaaactatataataacg

SEQ ID NO: 1209 - DNA, 332 bp, Bombus terrestris
tcaatagttactcgggggcaggcgggatattggtcttgccttgcccaagtcacactcctacctcctcgtggtaccgccggtaacacgcgcacgtccacatcagcgaggggcgtactcccccggatgtggcggcgcgtggctaaacggagtgtggcgacgaaggagcgaaagactaacaactataacggtcttccgtaacggctacttggagccgtgaataatggagcctatattaaaccctggaactcgttccttcgttctgttgacgactggaacggcaaaggacatgatttggataacaattggaaacttaatatcgaattcacaattaa

SEQ ID NO: 1210 - DNA, 422 bp, Crocodylus porosus
aggcgtctcctttaagggcaacggtctggttacgcggtcgcagcagkcttgckccaggtacctccwcgtggttcccgccgggtgccgmagmcccaggsctgtcggtagctcgatcctggcacagtamggccaggggagtkcttccttgctgcwggtgccccacaagcgtktggcagsmcmcctgcttcwtcgcaamaatmasagkgtsmtcagtagtcggccccgccgctagccaaaactgttcgccacscagttacagatggtgcctgtgctgacckgkkgccccgtgggctcggwggtgcaggggwggccggcccatggctgggccagacstgggccktggagcccgctcccamcccagagttccccctcaamgccgccaggkcagmamcakccggggagkgmcacggccccggccgtga

SEQ ID NO: 1211 - DNA, 149 bp, Drosophila willistoni
gaagctgggtcggatgagcgcagaaggggtgttctttggaacactgtaattcataagtcgtaagtctgatcaagtcgactcgaaacctcctcgtggtgtttcctgggtgctgttgagttcctagtctctaggttcttttcagtagctaa

SEQ ID NO: 1212 - DNA, 290 bp, Gavialis gangeticus
aggcatctccttkaagggtaatggtctggttacatggtcatagcaggtttgtgtcaggtacctcccagtggttcccgccgggtgscamagccccagggctgtcggtagctcgatcctggtacagtacggccaagggagttcttccttgctgtcgggtgcctcgcaagcacktggcagccccaatcgcttcattgcgaaaaacacaaacgtcctaaggggatgatcagctagtcagttctgccgctagccaaaactgtttgccacccagttacagatagcgtctgtgctga

SEQ ID NO: 1213 - DNA, 247 bp, Ixodes scapularis
gttccaaaggaaggcactcctttggttcgtgatgagatgttcatggtgcttgcctagctggagaaatccgactcacacctgcacgtggtccctgccgcctgccagtatgccgaggaaacgggtgcaacttaatccgtggatactggtagcaacgtgagcaacggtacggtccttcgcggaccaccctgggcgttcgggttgccagcccgttcgcccgaaatatcttggccctgaaactaaaagaaaa

SEQ ID NO: 1214 - DNA, 473 bp, Mnemiopsis leidyi
tgggggccccttggacttgctccctggggcaggacaccagtgaaaggagatcctcaagacaggacagagagacaggcacaccaacccttcgaacctgaggagacacccagatctggttaccccattcctgtaaccatggttgctctccgtgcgctgttaaggaaacccagcctagtaccctcggggaaaggttgcgtagtacttagcagtgtgcggatcaaacctctaccggtctctctagcgatgaaagtttctccgactggaacttgagggactggctagcccagctagcctgtagagcaatgcgtatacgatgccttggcgacaatggcgaccgctgcttagcagacggaggttagtgaaagggcgacttgctgttcatagtcacgtgagtcgtctagaaactgcaccgatgctgccctctgttccaggagaaggacagtggaggactaaatcgtagcgcgagcggtgtt

SEQ ID NO: 1215 - DNA, 1124 bp, Petromyzon marinus
ctattaatgggatgaagaagggggacacgagtttgtgtgtgcatccagtttccatggtgcatgcaggagtggtggtttaaatggcgagactctacagggcttccatggctacacgggatgcaaggcatcagacattttggcacaggcaatccttttggtctctaccgcaatcatgtcttagacctcagtagcgaccactacaaccacagtggtgactgctgttgagtgaaggacgactgagcgctggataacaactttcttgcgtggcccaacatcgaagcaaccacttcggagctggcacaaggcaagagggcagcccaaggtgtgaatcatctcaacttcactgcaggaagaaatgctgtgcaaggatgagtgtgaacgacaccaacgggattgttgctgaccaggaggtgccaaccaaatttgaatggattgactttgggcctggtttctcctgcgtgtattgcacggaaaaacaagtggctacacgtgtggccgtcgtgtcctggggtttcgcaacacaactccacaagatcgacaactatgaggatgacaatgtacttaaagaacaaagagactgacgccaaaggggatttaaaccgccaaatcgtacattgggtctcactacaatttttttacgtgtatttattttcctaagtgtctgtacttgccattcttcgctgctttttctgcattaattgcatatcgtatgcaaataagcgaattaaccaccaccgtgcaactatatgcagatgttacagctgagccctctatcataccggtgtactaatctggtatggtgttggcatgctatgcttgcgtaacgacctttgctgattggttcagtcggctgatggtgggttcaggcgaaacatttgtatattggtttaatcaaaccgaaacactaaaattttgaacacagttttccattacaccagttgtattgctagaagtgcaaatcgaaggagtcaattttgaccgacgattagctgccgatgtgcggtgaaaaagctgatcacaatagcatacacttgggccgacaaccccgtgtgctataaacgtaagtcgcgaattataaagaaaacaaaccggacggactactcggtgacgaactaacatcgctc

SEQ ID NO: 1216 - DNA, 1090 bp, Schmidtea mediterranea
cagtgctattcgaatgtcaatgtgaagaaattcaactaagctctggttaacggcgggagtaactatgactctcttaaggaattaagaatttacctgccktaktaaaartgaaatcmgttgttcatwgcaagtggtattgtacaccttcccgcggtgctagtcgtttaaaactaagttacaaaccacgaggggcgtcctgacggactgsaaaagcattgagrgtcmtgaagagaggctcttattgtacgaatctcttcaacgatcgaagtctggaccgatatgagaactaatacattagttgacaggtgaaaaatactgttgattacttagttctcagtcatgtggtatattgccagtcaattactacatwaatattagtgtggctctcaaaggaacacgattgrtcggcagtccaatgcgcgactggcgggcttgttgtttgcatttgttaccggctacttgaaaaggttatatatagcagacgcttaaagcgcgactgtaatttacatytcattgcccagtatttgtcttttgtcagatttagcaaaatttcatattttgttaattaccttaactggttaaacgatcccataattgcttgcaattattataaagtaattcaggtaaaaattacatatctggctgatcctgccagtagtcattttacttccgccgcgctataaaacagtttaaaaactgaataggaatcaaaaagaacatggcaagcgactatatgtaactgggcattcaacattccctattacatatggtggtgcctggggtctgttttatataatgggtacccgggaagtggatctgtatcaccagtcatggtgccatatctttkgataaagatacagtttaaaactgcgatgatactaatagagatcctcttagaccttcgtaaagaagtggggattgatgacattagcattggaagaattaaatctccaaggaaatggagtaacttcaatgaagtcccacaaccccgttgaagggctgggttcgagtatcgagagaaaactctaaattctcttcggttmtgtccaacggaggggacattactgtaaaatatcctctaaaaacaact

SEQ ID NO: 1217 - DNA, 743 bp, Strongylocentrotus purpuratus
tctcgcgacgcgttcttctgcctgatgaagtcacgtcaggtaatagacttagaaggttgatgagcgttcctctcctggaccgggggtgaggatgtgttctactgaatcatcgttccggttgtgaggtccgctgcaaataggccttggggtggtctacctccgggtcgctactccttttgagctagtcgatccaggtgagagtcggggaagcccacttaggtgggccagctaagcagatcacccccccagcacgacagtgcgctgtaatatagcctgttgagagtgcacccatttatactgttataaaagtataaatggttcttagctaacctatccaatgatttttattgttatgtataatactgaccactttagtctagtgtcatgtaaggatccgagacaatagcctatgtctctagtctagcaataacacaagagggataatccacctccctactccagccaccacctttacctttcttatcttccatatagatgccaaccagacgggtcgatgggcagtgagaaacaagaatggggataatttggaatttgacattctttcctaaagcagacctgaagggttaagagtcacaagcggagtccggactgtctttataaacagacaatattttcttattttaccacctatatggggatatttcccaactcgtaatatagggcccactgtcaagtggctggtataagttaccctgtgggtaacaaataaattcaaacaaaga

SEQ ID NO: 1218 - DNA, 1496 bp, Salmo salar
aatctttaaccccggactcttggggttcttacgactctgtatgaggaacagtcgaagagagggcgctaccaatccaagtatatgtcccaagagggctgggacagggtggaagagtgcacctcgcgatctggggcagggaaggaatggagagaagtcgaagaaggcttgtagagaaggggctctcctagatcctaacctgtatgacgcccgtaaaacggtgaccccagtagcgaataaaggaggcaggtgacaatagagggcagggccgacttcccaggtttacattgttgtacttgtcaacataaagaggtgtctcaatagtttgaatcaacaagggagaggaataccgacctgctcccttggggcgggggtactggtcttagcccggttccccgcaagtttcctttgcctgggatgtgcctgactggctccatcccctttccccattaggcacggctagatgacgcaccgatgggcgggtgtgtaggtcgctaccgaaggggactgggggtgtccggtgaaccaggacttcccaaaatggtctcacatttttaagcggcttgagtatcgcccagtatcctcgcgcggcactgggaacccagtcaaccgctctgtgccccggcgcaggcgggggtttaatgtctccccggcttcaccggcgcttcggcgacgacgcagaggagcacccggaggcccccatgaacttaaaccaacctatcttgaaatatggcctctcgttcgggtgaagggcaggtgggaagagagggctgcctcacgataaacacctagtcaatagccagtcgggaaaaatgtggaatgttaggacagggaggtaagggaggcggctttttcgtaaggctccttcaacccctacctgtagtccacctattgcaggtgttgacaacatgcaagatgacctgcctcgttacgggtcgcgtatcattgctacaggtcgtgtgccgcttctaagaggatagtaaggagaggttatagggaggtcctgttagggcttcctcaacccctctctatgcgattccttacaggagtggatcgagaagtcccggacgtaatacaccctggaggtaagggagtggccttctagtagggctgcttcaacccctctgatgggagtgtaccgggaacctcgacttgtaagcacaggttagtatgggagcagaagggggagccgtaatgggcttctctttcacctgcttacataatacctgtggtgcatgtatctaggtcttggcgggagagtactgagagacaaggttgagaccccaagattgggtctccctagcctctatagctgcgactcttagcggggatatggagtaacatgtaccaagggagtgaataataaaggaattgacggggtacaagtgactgttggcccgaatcctagccacttgatgaccagggatatattacagactgagagcgaatctagagacgtgagaataaagtgagaattggttgagcgaatacagaggaag

SEQ ID NO: 1219 - DNA, 173 bp, Tribolium castaneum
agtcatagagccagaacctcctcgtggtcccgctgggcacagggattaatttttctgtggcaaatttgactggcttcagagagcgtttttcgaagtggwctgtgtgactgcgttccccccttagttgctatwtccgctkmgattaacatctcacctcgacgtwtaagatcatt

SEQ ID NO: 1220 - DNA, 305 bp, Tinamus guttatus
ctggggaccgtggttacaacccgggcttagctgcagagacagtacctccccgtggttcccgccggaccccgtaacatcgggtgactgaatctgtctctgccccgggagtagttcctccttgccctattgaccagcggtcgccggctgctcaatagtattctaggcgtgaaatatagcgatagtcctagtggttgtcttactgggccatagccccttgcttcaggggtcattcgcgaagtctctcaggagaactgggggtggtgttcttctgggtatagctaaaccccctagactgtgtccgatcc

SEQ ID NO: 1221 - DNA, 131 bp, Trichinella spiralis
ctcctgactaacctgatttcgtccgtgcggcggcgttttcttttcgctctccgctcgtcgaaatttgctgtagttgattcgcttttctttgcgttttcttctactttcgcagttttttctgcattgccacg

SEQ ID NO: 1222 - DNA, 481 bp, Tetranychus urticae
ctctcttattttaacatattcgatgtactcgtacattgaatatgcttttattttttttcaaagttttttgggtgcatacccctggaaaattctgagatgtataaatctcccatcagctttggctgaaacgttggctaagttttgtaggttgtttgccccctactacttagtcgcaaatggtatttgctaacagttgttaaattgttacatttacaagtcctatccagtgcctcctcgtggcgctacccggtaacacttagagtaatctgagtggctaaactggaagggcggaaaatgcaaacaggcggttggtagatgcttcggcattttgccaaaaatccacggctttttagcccaacaacatcagggtgatggacccgccagcttgtggtcaggatcccatccatgaataaagcatggctctgcttctggtgcatcctcaacgggatcggcttcggctggatgtaagtcttgcggaggc

SEQ ID NO: 1223 - DNA, 157 bp, Drosophila willistoni
gaagctgggaagctgggtcggatgagcgcagaaggggtgttcttcggagcactgtaattcataagtcgtaagtctgatcaagtcgactcggaacctcttcgtggtgtttcctgggtgctgttgagttcctagtctctaggttctctccagtagctaa

SEQ ID NO: 1224 - DNA, 153 bp, Petromyzon marinus
cggtgcgttcccttgggtaaggaacacgagtcttagtggccttgacctccacgtggtcccgctggtaacatcatctcttgatgatggctaacaaggctaatgcacccattccatctcctatctcgcatggaggccgctatgcgtgattactag

SEQ ID NO: 1225 - DNA, 364 bp, Schmidtea mediterranea
agtcatagggtgaactgcaattctgacacgatgaccgagctgtgtcagtttgcagctagtcgctaaagactcgatcagtccgccaagtgaggtggccgggtatctgcagcactagagccactggtatcaagagcagagatacgcgagtggaagttgagtacgactaccttcacggggtcctcctgataaccacagtggactgtgggaactaaatgtgtgctcagcgttccctactttctcgtagggtaaagggtatgataacccagagaatatcccatgggagatatccatggaaaaagcaccacgttagacaatccgatggtctaactcggctccgaggggctaactatcccaaagggcttaa

SEQ ID NO: 1226 - DNA, 661 bp, Tribolium castaneum
tggaagaccccgcccatgaggcttggagagtgtgatcctgatcacacttgaaaagttatgctgagtacgtcgtgagagtcggtaactgtcccaggatggtctgggataggctaaacctcagcaggggaaagttgtaggggcctgccacccctacacttttatagatatggcattcgatacctcaaatagagcctcggacttggaggagcatggttcccctcctcctcgtactagacctggaaccaacggtcttgacaaccccattggacctacgggagcggaccatgctcatggacatggattccgaagacgaagcgggggaacacggaccccccgccgataatgctcacttaacgtcaggcgaacccatcgaaatcatcttgatgttaccctttcaaagcaggtcatgcggcatatgtctcaatgccggaaagggtggctcccgggcgtaacggacatctatcgctgatggaasctagctcgctcttgaagaacggcggacggggacttggaatcgtggtgtggttctgatgtaagtcctgaaattatggcgtgatggcccgcccgcccgaccggagggacttagaacccccttccgcgagggtcctgtctgtaggtccwccatctccgtaaaacgagttggaggaaaccgcagacgggg

SEQ ID NO: 1227 - DNA, 26 bp, Megachile rotundata
tctagttagcaagcggccccctctaa

SEQ ID NO: 1228 - DNA, 1095 bp, Apis mellifera
tggtaatcaaatgcctcgctattttagtagcggtagcgctccgcccgcgcaggaaccattgacgccgccgtagtgtgggtgattttatatccaaccaatcacgtcaactacgatcatttgtaatcaccgacggtacttggtaggggtaccacatgggcattcttgctcattccacaacgccgcctccatcatggcaacaatttaaaatatatataaattcttaaggtttgaccgtattcatatatatatatatatatttaatattacaaccataaatcttatatcgagccttctatttggtctcaaaagcaatacgttgtcagatcttgtagaacatcaggagtgagcggtgcgctgtggtatccgtgctttgtgccgcggcgacaaaccaatacgctgctgcctgtcgcaaagcaatacgctgctgattctcggatgcgggtgtcgacggtcacgcaaagcgatacgctggtggggtttcaaaacaatacggcgctggtgctaaaaagcattatgccgctaacggctggattgtcgatcgccgctgcgggggctagtggcgcacccagagaggtgcgacgcgcaagcattggttctgtgcgaagcggagttcttgagagtaatggttgctgggggcacaaagcgcaacatatagcctcttatgcctcaagtcgtagttcgtacctccacgtggtcccgctggaatgcctatcgactcctccccggaggatcatagagttcgaaaccggctacggcgaggcaagggcggtgaggtgcacaccgatggggagcagcgaccccacctacccttagctaagagagcaggcgatccgccaactgtcagcacgaaataaactaatcatatgtatacgagggagaatttacaacgggtaccttgtgcccgaaccgcctgtaggtatcacctacaggtgttaaaatgaatctgatagctggcggatcgtcgaccctctttgatggctctgcgccaacgactggaaagaataggaacggaagtctaatggaaggaaagtgtcgggagcactataaattcccaaagaagaaaagaaaagaaaaaaaataaaaaacccaaattaa

SEQ ID NO: 1229 - DNA, 655 bp, Nasonia vitripennis
gactagactatgggttcagtcagtcccaaatagccgatcctggcgcgtccggcagtaatgccacgtatgagtcggttacccatctctaaacgcgtagaggtggggagctaaaggccaggcggtttacccgacgtcgaatttctccaggtctgtgtcagtcgacggaataaaggtactacaacatctactatctatcgggatcggaagacgccttacagcgttttccgatttttgctctttgagcatttttcttcaaattgcgataaccgacccgatcacgcggggctttgacaaagcaatgcgtggtcggtaagatggttgcaatcttttccacctcgtttcttttacggaacgaaagcaatgcgtgtggggaacgttaaaaactcccttcatgcatcccaggatttatcctgcttactgcaaagcaatgcgtgtggagcgactttaccacgagtcgctccaccgcaaagcaatgcgtatcgcgcaaaagcaatgcgtgtgggggacttgtcaaagatcccccgccgcaaagcaatgcgtgtcggcaccacgtagagcaaagcgtgtaggcagactttgtcaaaagtagttctgccgcaaagcaatgcgtgtggagatcttcgccggtgaaagcaatacgtgtgggcgaacttag

SEQ ID NO: 1230 - DNA, 286 bp, Ciona intestinalis
cgacggtgaaccaccttgtcgcggtgtaagagctttagtgtctcgaacaagaaatagcttgtgtgctgtccttctgggcggtgcacatacttcttaacctcccgaggccatgccggcgggggctttagcccccggcaggttttaccatgccggacgggttcgagaggtagaggccaaactaagagttcaccagcagacttcgcacgcggctggccactggccgaagtttaaacaacagggccgcatcttcccaaactcaatatatggtgttaagtgaaccgtgccg

SEQ ID NO: 1231 - DNA, 189 bp, Nasonia giraulti
cgggttcccccgacttcggcttgccgtggtctggggctcactgctttttgtggagtcatggttacatggtgaccctggttcctcgcacccccgctggaaactatctggggaggccatgattgggtaacgataaaggtcctggtcgtgtcctcctgagataggctgaatgggtcactaagtggcacctaa

SEQ ID NO: 1232 - DNA, 165 bp, Lepidurus arcticus
ggggtagcaattgatcgattcccgcttcctcgtggcgctaccctgggtaatactatgaggaattgatcacaccgtagcgaacgtcatcagtcacagctgcacgaatccagatagaaatataacagacgagtaattcttttaaaagctcgtcagtaatcttcccag

SEQ ID NO: 1233 - DNA, 183 bp, Lepidurus couesii
tttggggtagcaattgatcgattcccgcctcctcgtggcgctaccccgggatagcctcaaagaaatttgacggtaaagcaaagaggaattgatcacccaaggcagtacatcggccttcctgcaggagctctgataaagatattagtgagttattctgttgaagctcgctatttcattcccctg

SEQ ID NO: 1234 - DNA, 192 bp, Lepidurus couesii
ttttggggtagcaattgatcgattcccgcctcctcgtggcgctaccctgggataacctcaaagaaatttgacggtaaagctaagaggaattgatcacaccgtgacgaatatcatcagtcacagctgcacgaatccagatagatatataacaggcgagtaattcttttcgaagctcgtcagtaatcttcccag

SEQ ID NO: 1235 - DNA, 184 bp, Nematostella vectensis
ggttggggccttctcgtggcggagtcgtgagtaaggggtataggggtaagggacaccacggaccgagaacggttaccgctcaaggcgagtggtggaaggcataaaatcgtaacgccgccctccgacctgctcctgaaactaatgccaaccaactgactgtggggctaacctccccagagtcagg

SEQ ID NO: 1236 - DNA, 340 bp, Schistosoma mansoni
atgttttaatttatttttgaactactactgtctgagtgcttcttacaacctgaaggctcagaaactacccactttttgctgtttatccacaacaacagttgtgaatctattctccaaatattccttgtgcttttgtcaacattattctataccaactgtaccacctacttcttcatctcacgttttaattctggtctaattttctcatcattagtcacggagagggcctatgaacggtccgtgacgcgaaattcaatccacgaattcgtcctcttctgctagtggtccccgaaatacggttcctctggcctgtcagttgtgttaaaactatataataacg

SEQ ID NO: 1237 - DNA, 176 bp, Triops cancriformis
tttttggtctggcatttgatcgtttccgcctcctcgtggcgccagactgggtaagctgatttatcagtgagctaagagaaacgatcaccgcaggagtccatctacctgcgctgcacgtgatttcattgtgcacttggcgagttatcccttgtggagctcgctcgttagcttttgag

SEQ ID NO: 1238 - DNA, 124 bp, Drosophila ananassae
agaatatggatttgattgtgcagagggggtgctataccgtaactcgtaagccatgcaatcagatcaagtcgactcaaaacctcctcgtggtattctctgggtgccagtatttactggtagctga

SEQ ID NO: 1239 - DNA, 285 bp, Drosophila melanogaster
ttggggatcatggggtatttgagagcagagggggagtattcttctgtaattcgtaagtcatatcatatgatgtgcggaaggggaattttactctgtaactcacaagtctctcctttactcaagtcgactcaaaacctcctcgtggtggtcccggtaatgctaaactcgtttagcagctaatttgagcggaaaaacttttccgatgggctggttccccagaggaaatttattcatattggaactacaagcacaaataacgagcctcggatacctttacacaatctg

SEQ ID NO: 1240 - DNA, 120 bp, Drosophila persimilis
aagatatggatctgaataatagcgtagaaggggagtcattccgtaattcgtaaatcgtaaaaatcagatcaagttgattcaagacctcctcgtggtatcttctggatgctattagactga

SEQ ID NO: 1241 - DNA, 128 bp, Drosophila pseudoobscura
caattggaaagatatgggtctgaataatagcgtagaaggggagtcattccgtaattcgtaaatcgtaaaaatcagatcaagttgattcaagacctcctcgtggtatcttctggatgctattagactga

SEQ ID NO: 1242 - DNA, 177 bp, Drosophila sechellia
gggatcaggggtaattgcgagcagagggggagtatttttctgtaattcgtaagtcatatcatatggtgtgcggaaggggaattttactctgtaactcacaagtctctcctttactcaagtcgactcaaaacctcctcgtggtggtccccggtaatgctaaacttgtttagcagctaa

SEQ ID NO: 1243 - DNA, 160 bp, Drosophila simulans
gggatctggggtaattgcgagcagagggggagtatttttctgtaattcgtaagtcatatcatatggtgtgcggaaggggaattttactctgtaactcacaagtctctcctttactcaagtcgactcaaaacctcctcgtggtggtccccggtaatgctaa

SEQ ID NO: 1244 - DNA, 135 bp, Drosophila yakuba
gggaacatggggtaaaggtgagtagagggggagtattttttatactctgcaactcataagtcttgcctttactcaagtcgactcaaaacctcctcgtggtgtttcccggtaatgttaaacttgtttagcagctaa

SEQ ID NO: 1245 - DNA, 334 bp, Kalotermes flavicollis
gagaggtcactgttgctgatcagctggacacctagctgactgcgtgcatgcgtgcacgccgcgcgccgcctcctcgtggtaccgctggtaacgcagggtcactgagactacctgcggctaaaggcgcgcgcgagggattgtaagtccaccacctccacgtggttccccgcgggcaacggcatagttcatctgccggccaagcgtgccgttccctcgatcctcctctgattagggataggaggggggcggtggctcccgccgacgacctggcaaacaccttggacacgctaagataataggccgtcctccgggccggccgaatcataagcacaca

SEQ ID NO: 1246 - DNA, 1138 bp, Reticulitermes lucifugus
ctcactgctgtcatgccattgttaatgcgttgggtgatggcgggtgatgggagacgagttacagcagagctggcttcacggggggggctgtagttgcccgaaccagtctgcttctgagtgcctccacgtggcctcgctggaaacgtcggagctgcttacggctaacccgtagacaactccggcggccaaactcagaaaacggccttactaccagggtcatccctcgcggcggcgctaagaccttactgtatgtactacggactacagttgagtagcgcgggagagcacttgatgtgagggtagcaacttgttgctacttcgactgtctccctgaagatttccgaaggggtgccgcaagtccatgggggcggtcctgctgtgggagttatcttgcacccgggaagccctcagtggataaatactccaaaatggcttagccacctcacgtggagagaggggaattaggggtttactcctaagggccgatgcctccaatcggatttccccgggcaacggctattatcagccggctaagttcggaccctcatctactgatgggatactctctctccccccgcctgcgtgattagttgggaatgcacgcgggcgggtgattctgacaagcccagcccaaaagttcttaccacgacgtacccgggggtgtcacccgaactaatatattttccgccgatcggttcgctgtggggggatgtcggggcctggtggccgggaaccgtcagccgctctttgagtgtcctgcgtaacccggaggcggtgacgtcgaagggctaggctagcacggtccagacccctgaacgcctggggagacgggcccaccacctgagtaggagtgggtcctttacctcatttgaggtgtctcctcgttcttgtagggggcgaaggacgaggaatgcatccgtccctccaggatgctggtggtttccgtctggtgggctcatgctgaaacgcgcaggtgccgatttgtcgaagaggacatatggggtaacccatagaacctaggcaggagtaatcccttagctgggggggtcagctggtgggtcctgtcaatttatcctcccctccatgccagagccggtccgaggttagagacggactcattttctcctttttatatgtc

SEQ ID NO: 1247 - DNA, 1137 bp, Reticulitermes urbis
cacactgctgtcatgccattgttaattcgttgggtgatggcgggtgatgggagacgagttacagcagagctggcttcacgggggggctgtagtggcccgaaccagtctgcttctgagtgcccccaagtggcctcgctggaaacgtcggagctgcttacggttaacccgtagacaactccggcggccaaactcagaaaacggccttactaccagggccatcccttgcggttgcgctaagaccttactgtatgtactacggactacagttgagtagcgcgggagagcactcgatgtgagggtagcaacttgttgcttcttcgactgtctccctgaagagttccgaagaggtgccgcaagtccatgggggcgacccggctgtgggagttatcctgcacccgggaagccctcagtggataaatactccaaaatggcttagccacctcacgtggagagaggggaattaggggtttactcctaagggccgatgcctccaatcggatttcccagggcaacggctattatcagccggctaagttcggaccctcatctaccgatgggatactctctctccccccgcctgcgtgattaattgggaatgcacgagggcgggtgattctgacaagcccagcccaaaagttcttaccacgacgtacccgggggtgtcacccgaactaatatattttccaccgatcggttcgctgtggggggatgtcggggcctggtggccaggaaccgtcagccgctctttgagtgtcctgcgtaacccggaggcggtgacgtcgaagggctaggctagcacggtccagacccctgaacgcctggggagacgggcccaccacctgtgtaggagtgggtcctttacctcatttgaggtgtctcctcggtctagtagggggcgaaggacgagggatgcatccgtccctccaggatgctggtggtttccgtctggtgggctcatgctgaaacccgcaggtgccgatttgtcgaagaggacatatggggtaacccatagaacctaggcaggagtaatcccttagctgggggggtcagctggtgggtcctgtcaatttatcctcccctccatgccagagccggtccgaggttagagacggactcattttctcctttttatatgtc

SEQ ID NO: 1248 - DNA, 1379 bp, Rhynchosciara americana
cagaacgtggagaaacggaataactacccagatccgttggttaaccggtggcaaagttaatcaaggttgccataggcttaataaccctatggaaatgtttccacacacctccacgtggtgcctgccggaaattgttctagggtgaacaagctaagttgtgagaaacgggctccaccacaatatggagcctgccagggcgcgagactcaggactctccatgtacaaagtggttagttgcaaaaagagtgcgcctagcatgactgataatttttcactgaaataacgttgaactttatctgtgtcatgtgcacaacactatggtgtctgatcaagcaccatcagtggtggacctgctaatgtattagtagaacgtgtccaggcgataatgcacacacggcctccgggcccatcgctttttttgagattccctagaaacttcagtgtgtgcgacaactgtataacccataagggatggacaaaggttatactagggggtaaaaaccctaatcggctaatggcaaatgggatgtagaaatgccaaagattactcgcaccgaataatggtggccgaaaagcgggtaatcgaatgaaatggtaatgctgtagcggaaacatgatcacattctgtgacagtaaaccattagacctagggggaactatgattaacaagataccagcttacatggaagcaatgaaatgtaagtcacagtagtgataagtggtgaagagtcttgtaatcaccgtaactaggccaggttctggggatgccatgaacttagggggagtatggttagcagatctaccagctaacactattactgataatatgtaagccgcagtagcgctaagtggtgtacagatttgcaaccaccgtaactaagttctgtttcgatggactagggggaatcatgattaacaagataccaacttacatggaagttatgaaatgtaagtcacagtagtgataagtggtgaagagtcttgtaatcaccgtaactaggccagatgtagtcaaagcacatgtttagggggaacaaggttaacattggtaaaagaccaatgcaacctccgtaactaaacgtgaaggcacaaaactaaaagtccagtggatgacaggtgaggtcatcactggacccaaatgttttaagctcatcataacaacacggtgaaaaatccagcatttatttgcctgattgagtagcttccacactattccaaagccgaacctatctgggtttttcttgaaaggccgtatagggcatatgtcgagaaataagtccaaggtgaggtagtgtggccctgtacccaggggtaaggtactatacggtcgagtggctcagtaggcctaactagccactgagtcactataatgactagtt

SEQ ID NO: 1249 - DNA, 979 bp, Ciona savignyi
ccaaaattacttccagcacctccacagcagacgaacgaagaaagaagacttacgaaataagaataagcagtttaaagacgaagcagacgaacaccactccaccaacgacgctctgcagctacaccaccaccatctcgccgcaacaagaagaattttccgctgctctccactctgctccaacaccacctctcctgctctgtggactgctgccttgctgctggaccaacctctacccgaaggaacccttcgaacccagcagcaaggtacgtgtcaccacctctccacagagccaaggccagagtggatagagcagcggcctctacaaccaagttctccactccgacgacaaaacacctgcctcgtggccagagtcctgccgaagaagaatcttcgaccccaacaccgtctcggcagggctccaagcaacgacatcagccacgagtgcccaccggagtggacgcggcgaacccgaggaccgctgtcgccaagaacaataacatcaccgcctgcagcagctaccaaacaaaggttagtctcctacctcacctacaaactcgtctgaatagacgcccccgcgtgggagctaaccttggtagctagctgcagtgccctgcgacagcggcctcgaagagctgcagagcgtcagcctgcttcgacctcgcttgttctcatttcaacctactccgtcctgtggaatcaaaagagccccactaacaattacattcataaaatctagcaagaacgaagagaagcgaccaacttttaatccataacttttagatctttttatttattactgtttttaagccctaagcatattgcctttttttagatcttataattataaaaatagattcaaagttaacaccaccaggccgctacagagcattttatttaatcaatttgttaccgacctcctgctgcttctttttactttctccagactactacccggatacaacccttggaaacgagagga

SEQ ID NO: 1250 - DNA, 418 bp, Bombyx mori
gctagctccctaaaatcctaccttacgtccgaggcgaacatctgtccacgtggggagcggaaacgcgtactatcgaaacttacgcggctaacaaggtaaaggtaacccattaatatggagacaagactaaaaagaaaattgagagggccgcttcccgggggcgatcgccggggcacacctggagctggcgctgggtgttccagcataggatccgtcagcggcggagagttgagcaggcgggctctcgccggggatttacaacccgaaaatgctacagccgccaacagaaatcacgatgtagaaagtaggagcaatagcccatgtgaaccttacagcccgagtaccggttcatacaacccctcggtacaatcatcaccatcatcctcgggtcatagaggctcaccaacgtcgactatgg

SEQ ID NO: 1251 - DNA, 17 bp, Anopheles gambiae
gaaggctaaccacaata

SEQ ID NO: 1252 - DNA, 539 bp, Bursaphelenchus xylophilus
gggatcctgggttcctactacctcgctccacctcctcgcgatggatcctggggaagtctccggactgagctaagagagcgttaaagtagagggtgacggcgtaagtacctccaagttgcggtggagcggaacatctactcttcggagagaggggaagctctatggcggcgttagaaaggttggactacggcaacgccagggagatggggaaggttcatcaggtgatactagttcgctactgtcattcgatgtatccggaaccatactcgccaagttgtgaactatgtgaaagtctggatccaatccaagaccacggggcgcaattaaaaggtgtgaagcagcttgctggtgatcaccacggtggtacctacaccggcgggggaacatctttaatgccgagatgaccgcgcgaataatagggagccggcaaaagccgagcgtaagtggaaaggatacagaaatttgctcaaaagtataccaacccgccacttataaaagaccgagaaaagggtaccactagagctcattataaaacatct

SEQ ID NO: 1253 - DNA, 919 bp, Heterodera glycines
tggcgatactcggaacctccggggagcctggtaggagttggcctacaggtcgcgaaagtccctaggtgctgcacgggttgcgctaatccgagggcgctgggttaccttcccatcggccaaaaacgtctgggccttcttagccgcgggtccagtatttctgttgagcctgacagttcttcccggatatggcgaaagattacagggcggtatttcgtgaaacctaaaaawggtcgggccgaatggcacggacagactcacttcggagtgagctcgggggcatccgtgtgttaccccgctgcaccacgccgaagctgtcatagcgagcccgaaggggaatggccatggagactccagcctcaccctgtaactcgaacctaagtccaggcccctttctggtgttggctcgcactggttaggaacacgacagtctcgtgtaatcccacacgcaccgaaagccctagccctcgtaggcgaaggctgcgttgctggtttcagaactgtgagcwagtggggttcggatggccgagtgtaccaacctgcttgctaacaggtagcatagagtaatatgctagtaagcagggcacgagaaagggccgtaaaggctccggctatgaaggaccttgcgaccacgcgtgtgtctcccacgtgcggattcttgaagccagagtcttgcactgcgcgcaggatggagcctgtgcaactcctccctcgctgatcgcaggagtggaggatcaccactctttttaccttgctagcttggggtaccaccttgagctggggccggccttgctagcttggggtacgaccctttgagctggggctggccttactagcttggcgcgccacccttggagctggggtggcgcaagatcacttgtatacggtctaaccaatacatttgaaaagcgatcaaagcgaa

SEQ ID NO: 1254 - DNA, 488 bp, Parhyale hawaiensis
ccgaccgccagcgggataactggcaaaccctgtctcgaccaccggcccgtgaatccatcggggcgtatgagtctgacacaggggggtgtttaaggtgaccctgttgcgaggaaatgcgcagcaaaagccggatgagccttagaacatcgaaggccaacgacaacctgccgaaagactggcgactaatccagtcaacctcctgtaggtcaccggctggtcatgctgaatctcagcttaaccaggcgtacgaacttacagttggagggtcgagcacccctgatggctgaaaaggaccatcaaagtcgaaggtagccaacgagaagaccaacggctgattcaggcggaagagtcaactcgttgaatgcgttcgacagcttggggtagatggaactcctaagccctgaaaggcagtccatcttcgcagacgctaaggtgccccgccgcctgagggttatcaggccccgccgcctgagggttaccaggcaacc

SEQ ID NO: 1255 - DNA, 791 bp, Bursaphelenchus xylophilus
gaggatcctgggttcctactaccctgctccatctcctcgcgatggatccttggggaagtctccggactgagctaagagagcgttaaagtagagggtggcggcgtagtgacttccaagttgcgatggggcggaacatctactcttctgagagagggaaagccctatggcggcggtagaaaggttgggctacggcaacacttgccatgatcagattcgatcaaaattagcctctggggctggcaaccctacaacggattgtaaactgaactatgctatgcaaaatgaaaataaaaaatgggggctttacaatctaaggtgttggcagatcacgaaaactgcccgtcgatgagggtgagataacatcctacggaacagcccctgctggaccaaaccaaatcatccacaaattggagggttttcttggtagtttcccttggcacgtcttgtttcataagccagaataaaaacgataccatacagacatgaggctgggtacctgccagccgcgacacggaaaaccggtaggtgcaaccggagacagctaggggaaagaaaatagtaaagtgtcgaaaacaaaacaggtagcccctggctagagggaatgggacattgtccgattaggttgccttgacccaatgaaagccaaccgggtttacattatcggtctaccaagggcaatgaccagagaaactgcgactatgccgtaacccttcgcagattgccgatgagaaccatcgatcgtaagtcgaagccaagcggattgaccagtggagggttatcccgacaacagc

SEQ ID NO: 1256 - DNA, 1171 bp, Heterodera glycines
tgtggcgatactcggaacctccggggagcctggtaggagttggcctacaggtcgcgaaagtccctaggtgctgcacgggttgcgctaatccgagccccttccggtgttggctagcactggaggggggggggtccaaagaatacgtgaagcggaccctgtgttttctctgacctcatacgggtatatcccgatgatatctatacagtgttcattttcatttcttaacctgctttttcctcaagagaaatatgaccacattcgtttgccatttcgaaggtgcgacttttgagggagttctcagggacatcaagctgttcatggacggcttgacggctcgtggcggcacgcagccgcgcgggccagttagggctggtgccaatgaggcagcgaagaagtctctgaaacgccaaaagcagcgggagaagagagagaaagcggggacgggttagagataatagcatgattgacggcgaagcaatactttgacttccaggtacggaggacggcggcaaaaagcaaaaaggggacgaaaccgatggcattgccaaaggggccgaaaccattgagctggacgctgatgggccgtctgccgcgcaaaaggaggggggagcccctccgtctgggaagaaggtgcggcgccattcgtccaacaaaccggaatagatcttgatgatctcagcaattgatcatattgatctctttttccagttgttgcgataaattatcgtgcattatttcttcgatttctccaaagcttaactcctttcctaatacctactcatgtatacgttagtaggcatgttttatgcaggtaaagatagacctggtgcccccgggcgacttgggatgtggatgatggttggcggagagttctgatgacgccgtagttccggaggaacagttcctactagtgccagcctgggctagtggagctggtctggcgagtgctttgctcgtcagataaggggtggttggggtggtacctctggaatgatgtgtcggataagcactctgccttataaagctgtcgttctgcccaggtttctcctaaccaggttgaacttgtaatgagcctttgggtatctggtcggggtctgcgcggagatagctcgtgaggagctgttattacattattggttgaacgcttttgggtcgtactgcacagataaat

SEQ ID NO: 1257 - DNA, 1414 bp, Strongyloides ratti
cgtcagaagagcaggtgtttttcaaagcaaagacttattctacgaaggggaaagatgatcaaacatgcagatttggctgcaatgaaatagaatcaaactaccatgtggtgacatcttgcaaataccattcatacacaagaagacacgatatggttgtgtacaatatattaaaaagactaaaagaaaagtataagttagatggtgatttacaatatggtagatcagtatttaatgggaagaaggaaaaaattaggatcagatctggccataagtttttgactgaacaaccgttagtaaacaataaaccggatattgttataacgatgaaagaagggaaaaaaaagataacgtacatactagagatgtcgataccacatatctagaacttgaagatgcaagaaagaataaagtataaaaaatattgtgtgagctccatggtaaaaataacgaatgataatgttgattcgatagctcgtgattttaatctactaaatttaatggaaagaaaagaaaggtgtaagataaagtttggatcatttgtatttggctgttatggagaatatgtcttgactgaatctgctctaagaacacagaaaatcctgattgaattgggattctccaaaaaagagatggatagcttgatcaaagagtgttcttacagttaaatgaatgagacagcaagaattattatgaaacatctagaaggcgaaaagaatcaagatgaaatcagccattaataacttttatttacccaattatttattgcgttaacttgattatatgatatttattgtatatttattgtttaatttagtttcatagtacaaataaaagaatatactacgattctttacttttaagttctacgagaacgttgttttagaatattttaataatatttctactacaattaagtaattagaagaaatcaacgaaagcagctaaacttactcgcaaaattcgttgatcgaggctggaatggcaccaactaatatactaaccaacaatagaaaaaaaaagaagaacttcagtggacttcaaataaaataaaattattggtagaattgtatgataaaactgagaaaatttgactaaaacaaaaagattagagcaaatatgtcatcattttcctaatcatacaattaaagcgatgatgacgaaattgagagaatttgaaagagaaaaaagggaaaattgtgaaattaaaatgagggaaaatgaggaaaaacctgaggaaaaattaaattttgacaactatgaagaagcaaaattgaaaagaggaattaagtgtaaaaaagaagtaaaaccaattgttattgaaaacaaggattaggaatttttgaaaacggaaaaattatttctcaagtttgtcaacacaatcaattaccaaagaaagaagggtaaatcaaccaga

SEQ ID NO: 1258 - DNA, 722 bp, Bursaphelenchus xylophilus
gggtcctcggttcttactaccgtgctccacctcctcgcgatggaccctggggtaggcctccgggctgagctaagcagagcattaaagtaaagagtgacggcgcagttgcttccaagttgcggtggggcggaacatctactcttctgagagaggggaagccctatggcggcgttagaaaggttggactgcggcaacactagccatgatcagattcgatcaaaatagcctctggggctggcgaccctataacggattgtaaactgaactatgctaacctgtcagtaaagacagaacgggggctttgcaatctaaggtgttggcagaccactaaaactgccctttgatgagggtgagataacatcctacggaacagcccctgctgatccaaacaaaatcatccacaaatcggagggttttcttggtagtttcccttggcacgtcttgtttcaaaagccagaatataaaacaataccgaagtacagaatggctggaacctaacagccatggcacagaaaaccggtgggtgcacaccggagacagcaggggaaagattgcaaagtgccgtaaataaagatggtagctctctgacctgagggaatgggacactgtccgattaatgccttatcccgaagacggtcaaggttctatcttatcggtctccaaagggctctggccatagaagctgcgaggaagccgtaaccctacgcagattgccgccgtgc

SEQ ID NO: 1259 - DNA, 1793 bp, Bursaphelenchus xylophilus
tgccagcggtgttgattaggtccaagttctttggccaaagatccgccctcggtttagcagtaccgaacgagtataccttcaagtggtggcactgaattagactgaatactctgaactgtagacttttgtgcaactgtgtatggtgtggaagacttgtttgtaccactatcagctttattggggctcgttactgtttcatacaggtagatgtcccctttagagatttccctgcagtttgcgctccaagtcgctagcctcttgcgtgtagtcaaaggaatacattcgccgtcggtgacagggctatacccggcgactacggacttgtttattacgtagtgcagcctcgtttaagacgaatgtgaaaagaaggtgtgattactaagcgttatgagtcgggttatctggaaactccgccccgccgcaatggcttcaagggtcaaactgctaacattttaaaccaatatttggcagcagcagactatgatgtcagagtgccgggggtctatcgatataagactgaaagcgatagacgtggagtgaaaggattccctttgttaagagaatcggtagaattcactttttacttattcaagaacttaacagcaacaagcactcgcgaggattaccgccccagattcggtcggcggtacttcacctgctttcttccactttcggaatctggcatcctggctttcagtgtggtgatggccggcttgagttttcttgagtcgtgcgagtgcctcatctgggacgtccggaccgattgatggagtctgcagtggacgaggacttgatggaccgtaaccatagtatatccctcatgcgtcttctcgactcgagggggtagcttgcactacccacccttctcttctccgattgggatttagacctagccctctggtgtgtctcgacccgcgatatcagattcctgaatcgactgtgagaaatgtctacgcgcaaagatcgacccattgccacccggctatgtggatcgggctcttgactgcttatctccggctttaatcgcttgaggaaaggggggtgtcgcccgaaagggttacgcgatcatccgattcctaccgtaaaaacgtagttgaagtaggattgaacctgagtaccaagtgaaaagagtggctataatgctccatggtataccctagggataaccgtgtcgagcgcactgctcaataccctgatttgttagtgtaggtatgtctagtggctgcctaggcagattcgcctattcactacgtaaaatctgggtgagtaccataagaacctcctgtagggccaggagtcaaactagtccaggttcggtatgcttcggtatactctctcacgggctagtcacctaagagttaagaaccgcctttttctgcactgtgaatagaaaaagaagggcgggagaatatacgggcgaggtaagcacgtcggaacggggtgtgcccaactcgtaccgtacgcccggacaaggaccatctttcgtaccccgttcacccggcacaagtccgattgtctctcccgagaggcgtcggcggaggttggctaacgccgtctctccaaccatcggtttgggtttaagtaacgccccagtggccggtagccaaactgatggaggcagaaatgccggtccgttgctaaatgcgggaacggaccaaaacgccggtgtggtggatacaggtggaagagtcttttggtctacgcaagaaaagaccaggctcaagtacgaatacgaccgtcttcgtgaacgacgccgtcgagacaaagttcgaaatcctacggtcgataaggcc

SEQ ID NO: 1260 - DNA, 450 bp, Ascaris lumbricoides
ggggccggtgggtttactcacttctgacccaccaccaacggaacgagggaaagcagagctggggccctcttccgattggcatggaaccgacctccacgtggtggccctgggcaacggaattcaagagaggatttaatcctctctatcatttgcaagatggatgagatcgaggtatccggcaaacaggttccaagtgagcacctttcccatagctgggaatatgggttaggcgtcctctgacatataagaggaatcagactcgttcgcgcccggtcattaacatcgatcagcgggagggccggactgaagtaaatttcctgttggcccgagtgcaggtggagctcggacccgaaaaacgatccctaagaggaccacaacccgaagggatggacgcagtcgccccggcacgtttggtgttggttatcctggagtgttgtgggacgaatagct

SEQ ID NO: 1261 - DNA, 100 bp, Heliconius melpomene
ataaataataataataataataataataagccccctaaaatccaaccatacgtccgagtcgaacatctgattctcgtggggggcggacacgtgaaaataa

SEQ ID NO: 1262 - DNA, 129 bp, Takifugu rubripes
ttctatgcgccttatgcgactggataggccagtggtttacgccgctgactttggtgcggaaggttgtcggttcgaatccaggcgagcccttaggcaaggctccttacgcatatatgcctacacctcggt

SEQ ID NO: 1263 - DNA, 325 bp, Taeniopygia guttata
ttcaggttatttagatgcttagtttttgtacctttcttgttttgtttaggattttgatagtgttagtatttttatatttttgtacgattgcataatgttcttttttatacagttctgttttaataaaatagacgatagctagagacgttagggcagccacaagccagttaggtagcggatagtaggtaggaacagacttttactatttcataacgcgtcaattaccacctgatttggaccaattcacgggatttgtccaaggtggacgggccacctttacttaacccggaaaaggaacatatataatttatgtgtgttcgataaa

SEQ ID NO: 1264 - DNA, 289 bp, Geospiza fortis
ggtagataatctttgtatagtggggggggatctcatgtaccgggtttcttttatttgattttcaataaaacagacggtagctaggttcgcaaggcagccacaagccaaagataggtagggtgctcatagtgagtagggacagtgccttttgattcacaacgcgtcaataccatctgacacggatacccttaccggacttgtcatgatctcccagacttgtccaaggtggacgggccacctttacttaacccggaaaaggaacatatattaattatatgtgttcggaaaa

SEQ ID NO: 1265 - DNA, 350 bp, Zonotrichia albicollis
gtagtcacattgcactttctgtaacttgcactgggtgtgggatgtgggcctggggtgtgggttatggggtatatatgtgggatattctggtgggaatgtccattcactgtatgcctatctttttaataaaaagacggtagctaggttcgcgaagcagccacaagccaatagccagttaggtagctcatagtgggtaggtgacaggaacctttgactcagaacgcgtccattaacatctagaacggaccaaacttcggacatgcaccgattaaccggatttgtccaaggtggacgggccacctttacttaacccggaaagggaacatatatagttatatgtgttcgtaata

SEQ ID NO: 1266 - DNA, 1449 bp, Danio rerio
aaatcccagcgggatacagcaagaaggtatcggatctaataaggttgagcgaggagagggtggagatcctttggggggggtcgggctaagttcccctctcgggtcctcccacggtgacgctctacccctccctcctcgctcgtagaacccaacggtgaacacggttggcaggatgaagtgacgtgaggggtaagacatgcgtacgtgagcgcgcatttttgctgttctctggactgggtttcgtccccctcacaaccatcacttacactataggggcacagcggctcctacctccctccctatgacccccccttcccataccgatccatggctgttctagtctggaccgagggtcggacggggcatttgaaggtagctggaatcctccgctgctgcgagcctgaggtcgatggttagaggtgaaatacttgggaggagacacagcctccggagagcccctcccgggtggtcatcatggcaaccgggtgaaaccttacggtttcacttacgaaacagcaccataacagcgccgtaatagcgcaccggtgtgactactgtccagtgctgatattctcatctggagaatacaacacgggtaatggcagagtattcaaaacccaaatgtttacgatcgaccaacggagtcgttcccttgcatctaggccggacccgaaactgccgtaattgcccgtccccaaggtagcctcttagaaaaccgaagcccggtcggggcggtggttgcggcggcgctgcgggggcctgctgctcgggcggcgtcggtgtgccgcggtggttgcggtggtgcggcggggatctcggtccttgcggtgccgctgtgccgccgcggtcgcgtcggtggcgctggggtggtggcccgagtggcgtcggcgtgccactgcccatagtcgcccgcgggggcgaccgatctggaggggcgagggggctcgcgggactttaacgagaaacggaacgcaacttctcgcatcgctcccgggactttcccccctcgttcagccgagggatgccaaaaggcatgaaaggtaagtaccataccggtccgcaaaactctcttctgactcggttctctgttggttttctagagtaacaacgaggtggaggagagggacatggcagggactcccattcgtgccagcgggtggggacagatcgaaggaacggttcgagggcgtaacagacgagagggaatccggtcacacattgatgccatgcctaaataggcgaggtttgtatttctactttgtgggttcagtatagtcggagcatatggtcggttgtcccgttgttttcacggcgggcaagcgactatcatgataaagtagaatgggagacgggctccctgacaaacccggaaaggcgcccccccgtggttcgtagcagctgacggatcacgctcgaagaaaaatgagtgagaggggacgccgcaaccac

SEQ ID NO: 1267 - DNA, 1155 bp, Gasterosteus aculeatus
ggaggggagtaggtctctactctgacccgaagggcccccccgtttcagacctgattctaggctacctgtgcctaattgggggggtcccaaagagatgttgtctgttgtagaagggtttgcgccactgactgcacggaagggtgggcctcgacaggtaggggttacatgactccgtgctgctcagcagacccgcgcctctgagaccgggtagggctacttgaacaagcgacgccctggtgtatgtccgtatcctaacctggtttgggaaagccgataccggcaatgcccgccacaggtgtcgcgcaccccacgggatgacgtatgggccccgggggacctcatggatactccactggacttgcacaatcctggtgtactggatgcagcgacgttggtgacataagcaatcgctaagtcggggtaggggaggtggggacctcggcacggctgtaggaacgggtgtatgggctccggcagccgtcgtcactcccatacaacacaggggctgcatcctggtggccggtgctagttggttctggaagcccgcccgggctggttcgcagaagcagggtgcgcccagggtaggtttggtatatctgggtccggtgcgatacctatcgatgggcagcgagggccgcctcgtgacgcgctgtgtggagctggagccggcctgggtatgaacagttcttgcggatgtggcgtagctagatagtacccgtggttgtgggcgtggtgtcgaccaaatgttgtcctgtgtgcacataggccaagggttacgtgggtggcagtcagaagcacccgcacctggaagtgattgccccgggatcccggctctctgtgaagagctaccttgaggaaaggtgttccgctggaactcaagaccctacagtaggggatatcaactggctttgaggtgctgtgattccggaaccagggcgagggcgagtacttagagcatgtccaaaagcccggggaacgttccgggggcctgcttgggtcgttggacccacatccgtaaaacgatggatctcgcgtcggcgctcgggagaacttcccgcatgaacgctgattgcatgtgagaacgcccccacggcggcggggcaggcgctccccctgggtgtaaggctcgggggggtcacggctccgctctaaaag

SEQ ID NO: 1268 - DNA, 245 bp, Bombyx mori
gccttgcacagtagtccagcggtaagggtgtagatcaggcccgtctgtttcttccccggagctcgctcccttggcttcccttatatttaacatcagaaacagacattaaacatctactgatccaatttcgccggcgtacggccacgatcgggagggtgggaatctcggggatcttccgatcctaatccatgatgattacgacctgagtcactaaagacgatggcatgatgatccggcgatgaaaa

SEQ ID NO: 1269 - DNA, 507 bp, Hydra vulgaris
taaatgccaaaagttgcttgggctaaatgatacgtacgctagaaaaagcgacttgctgcacggatgacggttcatcagagcccgatatgtgcatgtcaaggcggcagggagaatcactagtgtagctgttctttccattacgacttacgcggttaacgtggcacgatagatttacaccaggaaataatacgtgaagggttccaccatatactggagtttagatctatgagggaaacatttgtaataagtcagtctggtaacctggcgccgctgttgagtcaaattaactatgtcaatactcattaagttatcgactttgatatggcatggggtgattccgcgttatatcaaagtcaaacatgatgattgcaatgagaaactaccacgcttggtcacgtttgtgaggagaacatctcattcaagcctcccggatgtcggcacccgctgacatcttctggcttatgaaaattttcattaatttttgtaagtcatgggcggcttgaaagc

SEQ ID NO: 1270 - DNA, 523 bp, Hydra vulgaris
atgcccgaggtagttgggataatgatgcacaagctcgtaaggcgacttgctgcacgtatgccgctaaacgcttagctcgatgagtgcatgtcaagacggtcgggagtatgatcagtggagctgactttccagacaactcacgcggattcgcgtgcggtggatacaacacctggtataacatatgaagggttccatctagtacagggataacgatccatgggagcaaactaattagttggaggtaatccaacgccgctgttgagtcagtttttaaccgccagtcaactcttgtaggttatcggtcttcggcagaccttggaccgcctagcgccggccaacagtttgtcgtcgactaacatgatgatttgcgagagaaacccacgctttgtcacttatgtgaggataaaatctcttgtccatatgatcctttgaagggaacagcgctttgagcttgctcggcgttggcacctttagtctgtaatattttcttgatattatggacgaaaaaggtagtatggttgca

SEQ ID NO: 1271 - DNA, 303 bp, Adineta vaga
actagtctccttcttctattagtcagtctaattaatttttcttacattctacatctagttccattattaaattggtatgatcagtgctatctctgctacactcaatgcttaatcgtatgttattgacagtctgacacttgattactcttacgacatatgcactgtttgcttcagagaaaccactgttcatatagtgaagttcctcagttttctgttgatatattcttctttcattctcgcttctccttttctactgtgttctttttatcagttttttgtggaaaaattgagaataaataaagt

SEQ ID NO: 1272 - DNA, 108 bp, Oryzias latipes
gggggacagctgggagtctcggcatgattacaaatcttgcgctgcactcggatgtcgtccccgtgacggacacattaatccggaaagcgagtggtgactcgcctcaag

SEQ ID NO: 1273 - DNA, 148 bp, Limulus polyphemus
attttgtctctttccccaatgatgtctactagcacgctgccgaagctagatagattgaggaatctgcgtaatctgtaatgattacgcctcatgggcatctatcggtagcgtcgaccctgacgttaaattgggtaataagaaatatcga

SEQ ID NO: 1274 - DNA, 1570 bp, Caenorhabditis elegans
cctccagggcacgccgcacgccaaaagtcctggcataactctgcaaataacatcaaacgtcaatcaactccacaaactctccactctcttcaagtcttctcggtgcttccaacaccacaatggtgaaagctccttcaccttttccctccaaaattcttcccatgtggggaagtcctgttcttgtaagctctccggaggctgcaagagcagaagaaattcttctttctgacaaggtcagaaggaagtcctgttcttgaggcgtccatcccgggcgtcataggagagatcagatgcaccttctagcaggagctagaagggctgccctgtcttgagatccccacgggggtcaatagacgggaggggctgctggctttctctttttaagaggaagcaccaatccggagatccttaggggtcaaaggattaaaaggcagcaggtccaattctcctcactgacttcggtcagagaggagtcccgccttggagacctccccggggaggttgctgaagaggcggaagctccttctagcaagagctagagggagttcccagtcctgaaacccttgcggttgatgatggaatggaagagtacttcggtactgctcgttgctctctctgcgttttactgccgagggccggatttgctcgaatcgcgaaaggtctcaatcgaccattcaagatgacggcttatctaaggtccgaaagcagttgggagagtaacgtgttctcctacctttcaagttgaatggtcgttttactgtttgggatagctgacttgatgctagtacgcttcatctgtggatgacgctccccaagcagtcaagtagacttgaaaggtgccctcgccctagttagctcttagaccttatgggtcgccatggttgtggacgggtatgcttgccggagccgagtcgtgtttcttagaaccaacctcgacgaggcgaaagcttgcacaagttagcacaattgtggtagggccgactagaaaatgagtcccttagggggttacgccttggcgaaagtgaggacaattggcattgacgggtgcttcggcactaggcaaaggcgccaccacactgtccaatctctaaaaagttcacattcatcgaagaactaccggaaccaaccacacatgtgttgaaacctacacggtggaagggaaaggaaagcttcgctggaacgaaaagaacggataggttccccttcttgatggctgtgaggcttaggatggacgggaaggccgtgaggcctcaggcgggtaactcggccagacgctagttgatcttcggatcacgacagccctggctaagaggaaccctggatggagtgtgaaggatgggcgggtagggggttaagcctgttgacagaccaccgactgcagtcacaaaatcagtgattatgcgggtggaccaatctgttggcgggtgtttccctctacctgaccccgcaatatggtatgtacgatcctcggatctaaaattcataatggcccaccacaaccataaacctccctagcagctggtggtcccgataattcgggttcttgccactactgcgacccaggctcgcc

SEQ ID NO: 1275 - DNA, 130 bp, Cryptococcus neoformans
tgaggaagaggaggttggattattttttcttttctttaataagttgtttatttaagtagtttctttcattcgggcaacccacacgacaacccaataaattaaacaacgaaaaatgcaacctctataaccc

SEQ ID NO: 1276 - DNA, 60 bp, Chondrus crispus
taagtccttgacgcctgccccgtgatacagcatcggtacccctagcatttgaataaaaaa

SEQ ID NO: 1277 - DNA, 69 bp, Chondrus crispus
taattcaccttcatatctgctagtgtctctgtaagcgcacccctcatgcattgataaaattacccccca

SEQ ID NO: 1278 - DNA, 348 bp, Acanthamoeba castellanii
taagccgcgcgacgaggacggccaggacgaccaggacgacggcgacggcgaccacctagcaccgcacgcgccacgacatattgtcgcgcgctgtacaggcggctaggtcgagcccagccgaccgttctgagcctcagtcggcttgagcccccggcttcccaaggcctaccggggcggctctttttcgccctggtttttgccggcctgttttttctctcccccttttccccccttttccatttgtacttagtttttccttcggccgcggcagcttgttgcccggcatagtgttaatatgtttaaaaaacgtgtaaataaataactgtttaaccctaaccctaaccctaa

SEQ ID NO: 1279 - DNA, 261 bp, Fragilariopsis cylindrus
tagcaccaccatctattcatatccacacactgaccacctccaccttcacaactccactctcaattcccctgactactaagaaatatttcatggtggttacattggaggtatcccaacaccaagcacaaaatgaacccactaaccctctcatcctatccacggggaccacctttgagcagaacaccattcatattacaacctttagctagattaagataattatttagtacatattttatactattaaaaaaaaaaaaaaaa

SEQ ID NO: 1280 - DNA, 32 bp, Hydra vulgaris
taacttgtatttttaaattgttttattagttt

SEQ ID NO: 1281 - DNA, 27 bp, Lactuca sativa
tgaactatattttatatattaaaaaaa

SEQ ID NO: 1282 - DNA, 528 bp, Monosiga brevicollis
taggtaggcaccgtctcgggggtccctctgtggggatccctgtgtgcacctgtcgctccctaggtggttcctcgttgtgtcttttgatggcttgacttgtatttttgttttaattttgctttaatttttgctgtatttgtgtggtatttttgctgaatttttgtaaggtcctttgtatgatgtctttgtcttctgtggtcggttgttttcctcaatccgacgttgtgtctcgttggatgtgagcgtgccgtggtgttctttgtgtttgtgctgtgatggcttgtagttgtgatgtgtgactgcctttttgggtgtcttgtgtttgaaatggccgtatctctggttatacttggtcgttttgtacgatttttgtttctatgtgcgtgattcttcgcgcttgtacttcttggcatgatagaagccaatgaatgtgtcttgttctcttgtgttgttttgcgtgccgtcgtgattttgatgtcggggttgcacagctttgctttcagctctgaggttcaaacacctaattta

SEQ ID NO: 1283 - DNA, 38 bp, Hydra vulgaris
tgagctcttataaatttatattatagcattttgtttta

SEQ ID NO: 1284 - DNA, 363 bp, Magnaporthe oryzae
taataggtaacgtccctatttttgtctttggttttgtttttatctttgtttttgtttttgttttcgtttttgtttttgttttcgtttttgtttttttttttgtttttgtttttgtttttgcctttgtttttgtttttatctttatttttgtttttgtttttactttgttttatttgttttatatttaccttttgattttttctatttttcccacccttattattataaccccaacctactaatattttttcttttttcttttttctttttacggttttattttcccgtttgttttttctattttatttgtacgacaaaacccttagcaaataagcttagaatataataaagcgcgaattaaaa

SEQ ID NO: 1285 - DNA, 85 bp, Branchiostoma floridae
tgattaaagacccgaaacacccaatgaccccgggttcatcactgatgatgtgtccctgttcgcactaccagagtgtattctagag

SEQ ID NO: 1286 - DNA, 127 bp, Danio rerio
tgatcaaccccggctgggtcacctgggtgagagtgtatgatgttgagagacccgaaacactcaatgatcccaggatacatcactgatgatgtgtcccaaatgcatccatgagatgtttcttgcataa

SEQ ID NO: 1287 - DNA, 270 bp, Branchiostoma floridae
tagaaacccacaaggctgagaaatgtagagcatctgtatggacaatattgatgattgaaatgttgtgattttagatcaaatttagaaatatgaaaaccgaactaaactaaatataatgttttttttaaagtaatgataagcaatacccacattgtgcaatactatctatgttatgtcctttgtcccccctgcatgtttggtcaataatgaccatcgtgtcctgggctccgtgtacctttctttactatgaataaagaatgattttactac

SEQ ID NO: 1288 - DNA, 154 bp, Danio rerio
tagcatgccacttggacacaggccggggtctgatcagcctcggtcgggtcgcctggaggagggtgtctgttgcaagacccgaaacaccctgtgagcccaggaaacaacactgatgatgtgtccaaggttgtgcatcaggagatgtttctgtaac

SEQ ID NO: 1289 - DNA, 123 bp, Takifugu rubripes
tgatcaccccggctgggtcgcctgggcgagggtgtatgatgtcgtgagacccgaaacaccctatgaacccaggatacatcctgacgatgtgtcccagtgcatccaggagatgtakctttaagt

SEQ ID NO: 1290 - DNA, 128 bp, Tetraodon nigroviridis
tgatcactcccagtcgggtcgcctgggtgagggggtctgatgttgaaagacccgaaacccccgatgaccccaggtactatcactgacgatgtgtccaagacatgcatcaataggtgtatttagaaatc

SEQ ID NO: 1291 - DNA, 508 bp, Schmidtea mediterranea
taaaatggcaaaaagatatttcaagatgaattgtggactcatctaaaaaatgaccaccttgagtccaaatatgcctagctatcatggttgctgatggaaacagtaaggcacctgatagctaacttttcactgtgaatatcttcagatattcacagtgacacgaaaggacaccactagtaaaaaccactagttttttctgacacctcttgctacaaactctgtaaaaatcaaaaggatcgataggccgcgctttcacggtctgtattcgtactgaaaatcaagatcaaggaagcttttccccttttagtcaacaccaggtttctgtcctagttgagcttcccttgggacatctgcgttaccatttgacagatgtaccgccccagtcaaactccccacctgacactgtcctcaaaacagttcaattgcatccgaagatcgcaattttttcactaaaataaattaacaaaagttaattatactgcttcattgagtaagtagaaaaacaatc

SEQ ID NO: 1292 - DNA, 659 bp, Caenorhabditis brenneri
taaacccacacgagamctacgacgccataagatcaggcatgtacggatgtgaatgagactgatgaacggaatgagcacgtgcccataagatcgggtatkaaagawcagagacgatccctamcatcgggaaaacacgagttatactgcttcactgamctcgctaagctctcataatgaccgaacttgttcgcaactgcctcctaaccgggcgggtgtgagaagggaggtcgccttgaggcggacgcaatgagggatgtgtgcaggttccccctcttgagatccgaaagtctaaaagtactagaccgaaagatcgaggacggacgggatggccgcgaggcacacggcgggtaacacagccagataacctagtagatcttcggatctcgtcggcctggagatatgtggaaccctgggaaaggagaaagttgtttgttgggctggcaagagtgaagtttgaatgtgaaccaccgtcatgcaaccactaaaccagtggcgatgcgggtggagtcatcacaggaaaatgtttctgttgcttgacttatcagtgtttgatatcgccctcaggcacaagtatgaaggcccccacccacataaactccctagcaactggtagtccagcaagcgctggtwcttgctactattgcgccccaggctcgccc

SEQ ID NO: 1293 - DNA, 680 bp, Caenorhabditis japonica
taaaagccaaaagccacggagcatcgggaaagaaaaatggaaaaggactgaaaacgagactgaaaaatcccaaacaaaacaaatccaaaacaaactgaaaaaaaaaaaaaaacaaaacaaaaactggacagacactggaaacagtgtcaggcaaagtcgccgattatactgttccacgccttaaaagtcccgaaatggcgcaaaacaacctgaatctatctgaaagtgctccaaaccacgcacaactcggagaaaatcagggacaagttgcttcacgcaacgggctgggacaggtaccccctcctgaaaccgcgaggttgaggatggacgggaaggccgcgaggcttatggcgggtaactcggttggtgtgctagtagatgatttatatccgacagccccaactaagaggaatcctgggaaaggaaaacttgaaaaagtttttacagggctggtaatagttcagcacaattgtagtctactgtcttgcaaccacaacaaaccagtggttctgcgggtagatcaaactataatttgtgtgttttcttttacttgacccgggcaacacattataccacgtccacaaggacgaattcataatggcccctccctaaataaactccctagcaactggtggtccggcgaagccggttcttgccactattgcgccccaggctcgccc

SEQ ID NO: 1294 - DNA, 893 bp, Caenorhabditis remanei
tagccgatcgtaaaagaaaccgagccgtaacaacaagcaaagtaaacaaaagaaaaatcaataaaaaggaaggttgacctcagaccccgaggagggaagagagacaccsagaaaaagagagacgcagagaaaaggagagacacctctcataaggagaggtaggtcaatccaaatgtaaacagaaaaaaccagtggggaggaaagaaagactgatttcacccactaaaatgaatttggaaacagaatttggaagagaaaagagaaagggaaacctaaagaaaatagttctcttgccaaaattctgtagaggaatactttgtcaaaacatgatagaaaccagtaatctggtacgaaagacaagtaagacctgaactgacaagaaggaagtcagaaagaaataccgctcacaaagcctgtgatcgattctcttacctactgaacttgttctcttggcctcgtaaccggctaaagggagaaggaatgttaattggagatagacataaagataggtggagtgaaggtcctgttcttgaaactaggaggaatgtggaaagagcagaaggccgcgaggctttagacgggtaactcagtcagttgctagtggtcttcggatccaacggcttcggacatagtgaggaaccctgggtacggagaagaaatggaaaagagatagggcgggcaaaggctaagttcatacactgtcatgcaaccactaaaccagtgggatctgcgggtgaatcactttcgaaaagaagtgaatggacgtgctgatgtctgactttaaagaagtctgaaattaaaaaaacagatataaaggcccctcactataaactccacagcaacaggtggtccggcgaggccggttcttgccaccattgcaccccaggctcgtc

SEQ ID NO: 1295 - DNA, 409 bp, Trichomonas vaginalis
taagaagagataagacgagtgagaagaacagaagcatagtaggattggcagagcttaagcgatgtcactcggtacgaaacgtgtaccaaacaccggattccgtgctaggaatcacaagccaaaataaaagagacaccacgaaaattactcaccctccctcaaacagataataatattaacctcccatccatcagtccgtatggtctgataacagactagcaccacatccatgatacactcattggagtgaaaaccaccaacaacaaatccacctagaccaaatcctgccccacctccacccaagtagctcgcttcgctcgctcacctaaaactttgctcgctcgcttcgctcgctcgtcttaaccctttccgaataaacacttacaattcccggctcgccccatttttt

SEQ ID NO: 1296 - DNA, 1468 bp, Caenorhabditis brenneri
taaaccggctcctctgggaggaggtatgtcagaggacattctccgtgggcggatgggaggagtagggtaacgacccgtcattctggatgcctaaaccaccacaatctgtcaaggcaaagtgccccaaaagcacacgcgtggatcggtttggatgccgactgagccagagggcaaagtcgaaggccggtaggctcccggcgggttgtccgtcatagtcagtggtgcgcctacacccaactgctatgacacacaaggacaacccaaaataaataagccaaggcggcgttagcttcgagctaacaagctccccgagaggatggttgccacagggcaccatcctggggaacgacccgatctttcggatgcccaaccaccgccaatctgtcaggcaacgtgccccaaaagcacacgtgcggagcggttggatgccgactgagccagagggcaaagtcgtaggccggtaggctcccggcgggttctccgtcgtagtcagtggtgtgcctacacctaactgctatgacaagcgtataggaggcccggaaaaacaagccaaggcggcgttagctgagagctaacaagcttctcgtggatgggtgccagagggcaccatcctggtgggtggatggggggagcttgggaacgtcccgatccttcggatgcccagaccaccgcaatctgtcaaggcaccgtgctccaaaagcacacgcgcgggttggtttggatgccgactgagccagagggcaaagtcgtaggccggtaggctcccggcgggctctccgtcatagtcagtggtgtgccttcacccaactgctatgacatgcgtacaggaggcccggaaaaataagccaaggcggcgttagcatagggctaacaagcttctcgtggatgggtgccagagggcaccatcctggtgggtggatggggggagcttgggaacgtcccgatcgttcggatgcccaaccaccgcaatctgccaggcaacgtgcttcggawggtcattggttctagacttgtaatagaccattggccggaagagcacacgcgcggttggttggatgccgaccgagcctagagggtgcaaacctgaagggcgaggtcgaaggccgtgaggctcccggcgggaaactccgtcatagttagtggtgtgcctacacccgacgactatgacacataggaggaatcctgatctgatatgatcatgtatatagggagggcgaaggtaaatagtcagkgtcaaagtccacgtggcagctactccccagcatagtagtgatgcgagtggawccaactttgacactgatgttccctgagcctgacccatctgcacaaatccaacagtgtatgatggcccacacactgaggacgagtatcacttgtgatactcagaggtgtcccccatgatcaaccaatatcacagctagcggacctaccgtgaggtagacccccgccgctgtagcaggctcgcctc

SEQ ID NO: 1297 - DNA, 635 bp, Caenorhabditis remanei
tgaataccgtcagataagcccccaacataaaaataaaagtcggcgttagctaaccactaaaccggctcctcattgggggagagtatcattccggtgctctccgtttgggcggtagggaggagttgggtagcgacccggaagtatggatgcccaaccaccgcaatctgatctggcattgtgtttcggatggtctctgtctctagatctgaaatagagctctggcctgaagaacacacgcgcggaccggttggatgccgactcgatctggagggtgcaaacctgaaagggaaagttgaaggccgtgaggctcctggcgggaaactccgtcatagtcagtggtgtgccaacacccgacgactatgacatagttggaggaatcctgatctgataataatcattgttcatataagggagggggatggtaaatacccagggtccgaaaccatcaaagcagctactgaccagcatagtagtgatgaacacatagaccctggggttccctgaactcgacccatctgcacaaacccactttgtacaaatgaaccaaactgatgaagagtttaatgatttcttacatcacagctagcggacctaccgtgaggtagactcccgccgctgtagcaggctcgccattg

SEQ ID NO: 1298 - DNA, 1425 bp, Caenorhabditis remanei
taacatgccttggaaggcaccacgccaaaagtcctggcaactgatttgaataatgtataaaagtaactggaaccaaatgcccgataggtagggcgggagaaaatgacctagaaaacacaaagtcccaagcccccggattcgaaagacctataggaagtcagtgaatagagagaaatatcaaacaaatctcacccattcacaaggacttactggtcgagtagaaaacaagccaaaacatcaagcacgacgcaaaaaggggtaactttgggcaactaattaacggatacctccgtgtatcaggcaaagccgccaccaacagcaaattactgcccgataggtagggcgtgagaaaatgacctacaacctccaagacccgagcccacggaatcgaaagacctataggaagtcagtgaattgatggaaatacaaaaccaaatttcttccattcacaaggacttactggtcgagtagagcacaagccaaaatatcaagtatgacgcaaaaatgggtaaccttgggcatccaatcaacggatacctctgcgtatcaggcaaagtcgccaccaaactgtactactccgaaaaaaccaagaaacatgattttcccactccgttaaagcatctcaaccaagctaaagcggtaaggttatcatgtcaaaaggtgtagctacagcaacctaaagcccgaaaggtagggccgtataaaaagacctacaccctccaagacctaaacccacgaactcgaacgacctacaggaagtccgtgaatggagagaaatatctcaccaaatctcttccattcacaaaggctaactggtcaagtagagcacaagctaagcctccaagcacgaagtgatatgggtaatttaggcaaccaatcaacggatacctccgtgtatcaggcaaagtcgccacaaacactgtactactccgttactcccaaacacatggatctccttctctcaccaaaaagctttataaccaagctaacggtggaaaggacatcatgtcacgaggagtagctacagtaacctctctcttgagactgcaaagtcgaggatggattgggaaggccgcgaggcaaaaggcgggtaactcggccagacgctagtgatcttcggatccgacagccctggccttagaggaaccctgggataaggagcacgacgggaaggatgttccgcaaggatttcccttcccattagtcagggctggcagttggtaatatagcctttctacacaccaccgtcttgcacccactaaaccagtgggatatgcgggtggactcaatgtagaaaggtgttcccactgcctgactcgccaactttatatgtcttgtcaacataatggcccctcactataaactccctagcaactggtggtccggcgaagccggttcttgccactattgcgccccaggctcgcc

SEQ ID NO: 1299 - DNA, 146 bp, Schmidtea mediterranea
tgagtgtgctacgaggcagcgctggtaattgcatcggcgttgcagatttgtgtacgatagataaaaaccaatagtaataaatgctgagcctagctcgcatatctaagccgaaaggcagcatatatatgagacaatttaaaaaaaaa

SEQ ID NO: 1300 - DNA, 178 bp, Girardia tigrina
tgatccgtgtgtttgtgtcgtatgattgtttccgtgtgtgtctatatttttcttttttatactttcaattacctcgttgtaatgttataacttcatatggaatatatgtaatttagtttagtttagttagtttagtttagtttagtttagtttagttagtttagttagtttagttagt

SEQ ID NO: 1301 - DNA, 338 bp, Chrysemys picta
taaccgagaccgccgaccagggaaataacccacttccttccctgacgaaccaagggacgcaccccacccatgtacttattcgctacaccgatactgacttggactccttatacattccatgggtggcgtacccgagcccacttatccactgacactttaaaaactcttgcaccccaatctgggtctatgccggttatgcgatatgtatgtatctcttcatccttgcaaccgatacctgtaatccctcataacccaagcctgaccccagatgtacagtaccttccctcttaactcgtgtatatttaattttaaacattaactttaataaaatttttaaa

SEQ ID NO: 1302 - DNA, 124 bp, Acanthamoeba castellanii
taacaaccatgtatggtgaaccacacctctctcgatcttgtattctgtgattggacatcagagttcctgcgaagggatacactctgccaatctcgtgggttgtaataaatccacaccttcaaca

SEQ ID NO: 1303 - DNA, 668 bp, Acromyrmex echinatior
taaattattttgtctttgtcttggccccccctttttaaaccaagcaggagagagtggcccaatgcccaactattatatattaactatttactgtgatatttattatttgactgttgggcgggcccctctctgctggttttatttatatatattttttactcgcgtactttttgtactactctatttttctttttattttagctatgctatttttatctctttctttgtctctattttctttctttttttctttccttttcttttctttcttttattcttcttttatttatctttttttcttttctgttgtggggccctgaccgtccgagtgtgaatgccgcgaaaaacaatattatgttttatacgagtgtgcatgtgcgtgatatatttatctattttattttatttatttattataatttattgccgcgcgcgctcctccgggacttttattcgttgacaatactgtgatatttttctgckcaggctgggggggcttgccccccagccccttagttttaattgcctatgcggggggggcttttgtcccccgcaaatgtatatatatatatatttagcgcgcggcttagccgcttttgtttgtattaccccagaggggaattgtccctctggggaaaaaaaatgattggaaaaataaagtgagctaa

SEQ ID NO: 1304 - DNA, 408 bp, Alligator mississippiensis
tgaaccccccctctgcaccagatggaccttcacttcgagaggattcttcagcaatggacgaccccgctccacccgaagaggacccccgcgatgagactctatatggactgagacactttttcttcgaaccacttcctccaccattgcggaccattgtaacgggtttgtgtgtatctatcttctttctctctcagcgtcgcgaaccccctccctccccttcccctccccctcccccccacccccgggcttagttggctaacattgtatctcctgtaacctagttgcgttcccctcctcacccccatccctctattgttagtccctcgctcgggcgctctgtatttccctaccggctttgtcatcttttttggattcacaatcctaaacatctactaataaaagtcaatc

SEQ ID NO: 1305 - DNA, 401 bp, Chelonia mydas
tgagccggtacgacatcgtgcatcaactatgagaaagggactgagagactttttccattggaccatatgaactggaaccataaactcactgaacattaaatctcaccaaatgagggtaaatccatcctcatcatcgtatccactcattatactccacacctgaacatagccattatatgaacaacatacccccatatctcaatgtctgtactttgacccgttaaccttttacccccaatcggggatattgcagattatgtattccttacgccacccgatcctaaaccgaatttcgcaccccttgataatctgtaccttattccctgataaccagaaacttctatgcttaaactctgtaccgtttttttttatttcaacatcatcttaataaaattattaaa

SEQ ID NO: 1306 - DNA, 402 bp, Chrysemys picta
tgagccagagtgacatcgttctcccactacgagaaagggaccaagtgaccttctccgttggatcatatgaactggaaccataaactccctgaacattaaatctcaccaaatgagggtcaatccatcctcatcatcatatccactcattatamtccacacccgaacacagccactctatgaacttcataccctcatatctcaatgtctgtactttgacccatcaaccttttacccccaatcggggatattgcagattatgtattcctcatgccacctgatcttaaaccaaactttgcaccctcgataatctgtatgttattccctgataaccagaaacttctatgctcaaactctgttcactattttttttaacatcatcttaataaaatttttaaatctgtt

SEQ ID NO: 1307 - DNA, 228 bp, Drosophila yakuba
taaaaaattaaaatgccttaaaaataaataaatatatcaaaatttaaaaaaaaaaacgaggaacaaataaacacaaattctgaaagatttatataatttaaaawataaatcgaaaataaatgttgaaaacaaaaaaaaaataataataataataaaaacacaataacactcacccggcctgccccagaggcaggtaaacatttactggccatatggctttttttttaa

SEQ ID NO: 1308 - DNA, 408 bp, Gavialis gangeticus
tgaaccgccccccctccgcgccagacggaccttcacttcactccgagaggattcttcgaccacggacgaccccgctccacccgaagaggacccccgcgatgagactctatacggactgaggcacttccttcgaaccacttcctccaccattgcggaccattgtaacgggtttgtgtgtatctatctcctttctctctcagcgtcgcgaaccccctcccccaccccccacccccgggcttagttggctaacattgtatctcctgtaacctagtcgcgttcccctcctcacccccatccctctattgttagtccctcgctcgggcgatctgtatttccctatcggctttgtcatcttttttctggattcccgatcctaaacatttactaataaaagtcaatctgttcttt

SEQ ID NO: 1309 - DNA, 297 bp, Lytechinus variegatus
tgaatagcatttatattgtgttccaaacaacatactcattattatatctaaacatttttttttctgttcctgacaatctacgtaaagtctgctaaccaactggcatgatgaaataagataaaatccccttacacattaatttcttgtcacatcataatgctttgtcaaagcaatgtcctacataatatctcgatgtcaccccaattaattttacatccttcggtaacctttataccgttggatcaacatatatgatttgtaaaactgttatttctgagttttttctatgctaataaa

SEQ ID NO: 1310 - DNA, 257 bp, Nasonia vitripennis
tagtggggccataacacctaggccccacagtgtggcgatgtccatgtgtgtcgtccttacttatttatttatttgtcctgtcgagctgtttaatctattcatatgtatgtgttgtgtgtgtcgtccctcgtagcagttttattccgtccaaccagaggtcgaccaatattaaaataagcatggcttgaagcaggccaagcgccgtgttctaaccccgttttaggggaagttacttaacctaaaaatacaacttttcc

SEQ ID NO: 1311 - DNA, 246 bp, Phytophthora capsici
tagacggcacagttctggcccacgtaggccgaaagggccccacccatgtagggaaccgccctcgggaaatccattccggtgttcgactgaagagatgctccttcgccttgacggaggtacatctcgacagtcgaacttcaactcgcaacatatccgatacagttacaaaccacagttagatatcagataggaaccttcctttaggaagctaacgggtacactggatggtaaatacacatacatttc

SEQ ID NO: 1312 - DNA, 948 bp, Phytophthora infestans
taagctggtcatcatgaccgacagggcactacccaggtagggaaccgcccttaaaaaacccaggaagacacaaacaccctccacttagtgacatacatattttagcctagatttcagttacggagaggttactaactggtaaatacgaacacatattctgttctaatcagtgtgaaaactggttttcgccttttggcggactttttcactcgcatttttgggcaatcgtctgcggctagcttgctagcggcggacgagcggtctccgggggcgttcacctttcccccgcgaggccaactacaccgatcttctctacacttttctaattcgcctccgtcttcggtcttcggttgtcgggcttttttctttttgaccaatcagagcgcgccatgcgcctcttctggccaatcagagaccgggccctgtcctcggacagcgaggcctccacggccagccaatcgagtctcggcagcgacgcgtctttctatagcgcagctgacgaggccgatctggcggcccccgattggtccgactttcggccaatcagcgacgacgagggggcaggggtttacacttttgcccccgtttcgacttcaacttcaggccaaaatggcgatttggaccctccacgcgccgtgccactgctcggcaccggcggcgattcagcgggtgcaacttcgggcacgtgtgcaacacatgcagcgcccattgcacgccaagcggcatcgcgggacgacgcctcggccgcccaagcgcagccccgcccttccagcacgacctcgcgccgtttggcggatcgccatcaagacgtgcgagagccaggcggggtcgggcaaaatatacttactctaagtatgcccgaatccctgccctctcaggctgaacgcggccccatacttgatctaagtatgggaggatccctggcctctcaggctgtacgcgagaccc

SEQ ID NO: 1313 - DNA, 1277 bp, Patiria miniata
gattagcgaacactaatatcctgccmtagacgtgattgctaatccgcaaaccaaccggatctacagcctgaacactgaactttaatcttcacccatgtcacatctggacactaggtttttgctctgtttgtgttttcctgcctttwcmttggawctttcgcmctggaatttatttgtcgcttggattattttttttctcacaatttggatctattttcgtttgttcacttcgaactctagctgccctttcttcggacactgaactttaatcttcgccatggctgtcagtcgccggttcacttgctgcggtgggatcctgttgtgataatccccgtgcattgcccatggatttatttccgccttagttgttcctaaccttggatttattgctgtgggtgatgcccgggttttgtttacatcgggatcccgctgcggctcggtgttccatgcgactggcagcccctttgtttactctsgactctattcattgttgtatttcttccacactggccagtgatcacactgctgtgtttcccgggaagatatcctctgcggttttcacgctctgggtgtctccccgggcaacgcactggttgcttgctgcgccatcacccttttcgtttatattcattttcagtctgccgttatcttggccagcgctcattcttttgtgatggccgtggactgaccctctgcggttttctgcggtcascactctcggtgaatgctgtgccaccatttttcatttgtttactttttcagctacaattatcctggccagctttcactcttttgtgatggccgtggacggaccctctgctggttttcacgctccgggtttgtctgcggtcagcacccttggtgagtgctggtcgtttgtttgctcattttgcttagttcaccattatctttmttctcttttgtwtggttttcctagcggttgtctgggagttgagctgcagttgtctggtcttggttttacccccatttgttttcttttaacgcggggcgtattgccttgaccggccgtctcagcttttctcctagagcaaccttccgttcatccaacttttagttttctcagttcttggccattccggttggttaatttttatttatacttaattttatgtttacattttctggttggagaccattttagcttgttttaatagcttttcttctttaattaataccctctgccattgagggtttttattactattaattttgtttactctttgtaacttgtttgattgaatattttaataaaccac

SEQ ID NO: 1314 - DNA, 346 bp, Phytophthora sojae
tgaagctgcacaagcgcgaggctcgacagctggaccttcagctgtcgagccactgcatccgcgccagccaccgcacctggggctggtactgccggcgccaccgcgaaggacaacggagcggcaacgcctcgcgagcgccgcgtgggtctggggggggcccgcggcgcacatcgcaggctcgggcacggcggtaagctggtcatttgaccaacagggcactacccaggtagggaaccgcccttcaaaaacccaggaagacacaaacaccctccctttagtgacatgcatattttagcctacatttcagttacggagaggttactaactggtaaacacgaacacacat

SEQ ID NO: 1315 - DNA, 159 bp, Pythium ultimum
tgatgcgggtcatattgaccgaaagggcaccatccacgtaggacaccgccctcaaaaacccagttcagtttattgacaccctccacttagtgacatgcatattcaaaccgatacatattcgttaggagaggttactaactggtaatatatcaccatttc

SEQ ID NO: 1316 - DNA, 371 bp, Strigamia maritima
tgatgggagagtgaggaatcttctccactgtgcaaaaccatacagtcagaagatgctaactactagtttgataccctgtgccccctgcaatgtcccgcgtgtcgtacccaagcccggctggcattgagacacattaggctctcgctcccccgtatactctcataatttcgtgtacgctaatcctaccctacccctccctttgaccactcacccaaccatgtgtatagctgtgctggtgatcccggggcggttattcactggttatcatatcattctaaaatgatctttgatctctcaattaacaactaacttatttctgtttgtttcattgtttcacctcgtaagaggaagttcattgtgcgataaatcaa

SEQ ID NO: 1317 - DNA, 317 bp, Strongylocentrotus purpuratus
tgacgaaatgttcaatatatgacattctaatgttcatgtattttttgtttgcttgacaaagctagatgaatatattccctgtcctactacatacatctcgatgtgcccttgctagacgatccattggtaaccatgatatcaatggattaacacatgatctgtaaacaatatatgatttacacaatgtatttattgtttcaataaatctgttcttttcactttaatacatgaaacatgactgtgccttctccaactggagacctacataatttgttaaaatgatataaatatttcgaagatgaaattattattaataa

SEQ ID NO: 1318 - DNA, 134 bp, Trichinella spiralis
tgatccgtcccgaaccaacggaaccacattgccgcatgacttcgatttcgcttttgctctttttgtatttaattttgctattaacaattcagtttgttaactgttttgtattcatttgaagatccaaataaaac

SEQ ID NO: 1319 - DNA, 394 bp, Chelonia mydas
tgagctggagtgccgatgagaagcgcagtcgggaaagtaactgaaatactttcctcatggattgtattttctaaatggacaacctacctaattctcaattactgagggacaatctccactcattgatatattttgctttccacaaccaaatctctgtacaacttttcatgagtgatgtacccgagtacttggattctaatatctaaactgtattgttaaatctattcacctaaatttgggttattgctgattatgtactctatgtatcatatgacttttaaaaacaaactttgtatttgtggataatctaagcactatacccagatgtacagacactcttttcccaacctatgtattatatttttttaacattagctttaataaaatttttaaa

SEQ ID NO: 1320 - DNA, 155 bp, Phytophthora capsici
taagctggtcatttgaccgacagggcactacccaggtagggaaccgcccttcagaaacccaggaagacacaaacaccctccctttagtgacatacatattttaggctacatttcagttacggagaggttactaactggtaaataaaaagcacttt

SEQ ID NO: 1321 - DNA, 1015 bp, Phytophthora infestans
taggcggaaaccaggcccaagacggccgacagggccccacccaggtagggaaccgccctagaaacccatttcggtggtcgactcgaaggccttacctattttttccttagacattcaattaggtagcgaccaaattacaaatttggtaacgagtaagccaaatggtaatacacaaaacttttctgttctaatcagtgtgaaaactggttttcgccttttggcggactttttcactcgcatttttgggcaatcgtctgcggctagcttgctagcggcggacgagcggtctccgggggcgttcacctttcccccgcgaggccaactacaccgatcttctctacacttttctaattcgcctccgtcttcggtcttcggctgtcggatttttttctttttgaccaatcagagcgcgccatgcgactcttctggccaatcagagaccgggccctgtcctcggacagcgaggcctccacggccagccaatcaagtctcggcagcgacgcgtctttctatagcgcagctgacgaggccgatctggcggcccccgattggtccgactttcggccaatcagcgacgacgagggggcaggggtttacacttttgcccccgtttcgacttcaacttcaggccaaaatggcgatttcgaccctccacgcgccgtgccactgctcggcaccggcggcgattcagcgggtgcaacttcgggcacgtgtgcaacacatgcagcgcccattgcacgccaagcggcatcgcgggacgacgcctcggccgctcaagcgcagccccgcccttccagcacgacctcgcgccgtttggcggatcgccatcaagacgtgcgagagccaggcggggtcgggcaaaatatacttactctaagtatgcccgaatccctgccctctcaggctgaacgcggccccatacttgatctaagtatgggagggatccctggcctctcaggctgtacgcgagacccgtacggccgaatcccctggcctctcagcctgtacgcggggc

SEQ ID NO: 1322 - DNA, 380 bp, Phytophthora ramorum
tgagcaccttgggttgctcaagcgtgatgcgaagcggctggaccggcagctctcggtggcgtgcatccagtccagccgccgcatctggaacctgcactgcagccagcaccgcgcgcgccagcaccaagcaccagggggaagtcgggcggcggagaccggggggactccgccgcgcaccggccgccgctagacggcacacaggcccacagcggccgacagggccacacccaggtagggaaccgccctcaaaccccgccggtacattatggtccgacacctatgaggtgcaacctgtacacaagttacacaccacatagcgactaccaggtatttactacctggaagccaaggattaaccggtcggtaatacacataacttt

SEQ ID NO: 1323 - DNA, 210 bp, Pythium ultimum
taagcggggggtccagaccccacaagagagaagcaggaatcatggtccgcatggaccagtagggcacgctccacaaaggttatcgccctcaaacccatcacacgaaggatctaaaaagaaagcaacaatcgaaatagtaaatagtaaatagcttagaaaggtcaacatgcgaaatgcatgaggaacgtaagatggtaatacatttttata

SEQ ID NO: 1324 - DNA, 1098 bp, Phytophthora infestans
tagacggcaaagttctggcccgcgtaggccgaaagggccccgcccaggtagggtaacgccctcgggaaaaccattctggtgtttggctgtttttcaacagtcgaacttcaactcggagcatatcagatacacttactcacacatttagatatcagatagggaacctttattagggagataacgggtacaccggatggtaaatatacaaaaccttctctgttctaatcagtgtgaaaactggttttcgccttttggcggactttttcactcgcatttttgggcaatcgtctgcggctagcttgctagcggcggacgagcggtctccgggggcgttcacctttcccccgcgaggccaactacaccgatcttctctacacttttctaattcgcctccgtcttcggtcttcggttgtcgggcttttttctttttgaccaatcagagcgcgccatgcgactcttctggccaatcagagaccgggccctgtcctcggacagcgaggcctccacggccagccaatcaagtctcggcagcgacgcgtctttctatagcgcagctgacgaggccgatctggcggcccccgattggtccgactttcggccaatcagcgacgacgagggggcaggggtttacacttttgcccccgtttcggcttcaacttcaggccaaaatggcgatttggaccctccacgcgccgtgccactgctcggcaccggcggcgattcagcgggtgcaacttcgggcacgtgtgcaacacatgcagcgcccattgcacgccaagcggcatcgcgggacgacgcctcggccgctcaagcgcagccccgcccttccagcacgacctcgcgccgtttggcggatcgccatcaagacgtgcgagagccaggcggggtcgggcaaaatatacttactctaagtatgcccgaatccctgccctctcaggctgtacgcggccccatacttgacctaagtatgggaggatccctggcctctcaggctgtacgcgrggaccaagtacagccgaatccctggcctctcagcctgtacgcggggctatacttggtctaagtatgccccggtcgctggcctctgagcccgtacgc

SEQ ID NO: 1325 - DNA, 242 bp, Phytophthora ramorum
tagacggcaacactctggcccgcgtcggccgaaagggccccacccacgtagggaaccgccctcgggaaacccagtctggtgttcggccaagaaatgcaccaccaccacggcggaggtgcatttcgacagtcgaacttcaacccgccacatatcggatatagttacagctctagttagacatcggataggaacttcttagaaaattaacgggtataccggatggtaaataaaataaaaacttc

SEQ ID NO: 1326 - DNA, 1036 bp, Phytophthora infestans
taaacgggtcacttgaccgacagggcaccacccaggtagggaaccgccctttaaaacccaggaagacacaaacaccctccacatagtgacatacatattttagcctagatttcagttacggagaggttactaactggtacataaaattacacattctgttctaatcagtgtgaaaactggttttcgccttttggcggactttttcactcgcatttttgggcaatcgtctgcggctagcttgctagcggcggacgagcggtctccgggggcgtacacctttcccccgcgaggccaactacaccgatcttctctacacttttctaattcgccttcgtcttcggtcttcggctgtcggatttttttctttttgaccaatcagagtgcgccatgcgactcttctggccaatcagagaccgggccctgtcctcggacagcgaggcctccacggccagccaatcaagtctcggcagcgacgcgtctttctatagcgcagctgacgaggccgatctggcggcccccgattggtccgactttcggccaatcagcgacgacgagggggcaggagtttacacttttgcccccgtttcgacatcaacttcaggccaaaatggcgatttcgaccctccacgcgccgtgccactgctcggcaccggcggcgattcagcgggtgcaacttcgggcacgtgtgcaacacatgcagcgcccattgcacgccaagcggcatcgcgggacgacgcctcggccgctcaagcgcagccccgcccttccagcacgacctcgcgccgtttggcggatcgccatcaagacgtgcgagagccaggcggggtcgggcaaaatatacttactctaagtatgcccgaatccctgccctctcaggctgtacgcggccccatacttgatctaagtatgggaggatccctggcctctcaggctgtacgcgagacccgtacggccgaatccctggcttctcagcctgtacgcggggctatacttggtctaagtatgccccggtcgctggcctctgagcccgtacaca

SEQ ID NO: 1327 - DNA, 193 bp, Phytophthora ramorum
tagacggcacacaggcccacagcggccgacagggccacacccaggtagggaaccgccttcaaacccggccggtacattatggtccgacacctatgaggtgcaaccggtacacaagttacacaccacatagcgactaccaggtatttactacctggaagccaaggattaaccggtcggtaatacacataacttt

SEQ ID NO: 1328 - DNA, 1063 bp, Phytophthora infestans
tgacgcaccgtgacatagtgcggcacgtgaagatgcacatgaagctccgacactgggccaagtgggcggccatgcgcgaccaaggcaagacagctcgtgcacatggtggggttggtagtggcttcctcacacggccgcgaggcctgtgggaagccgactaccggttcgcggtggccggccgcttaaaccaggtagacacgcacagtgtcctcaagcgccggcgcctccgagcacatgacaggtgcagacacccaggatgcacgcgctccgagacgctggcgcatgtgcttaaccactgcgacggaaccatggacgcagtccgtggccggccatgacgccgcactcaagattattgagcgtgcgctcctcgcatcgtcggccgaccagcaggaccgtgctgagctccgcgtgaaccagaccgtgccgtcactcgccggccccgcgctacggcccgaccttcagctctacaaccacaccaagaagacggtggcggtggtcgacctggccgtggcgttgaggagcaggcgagtgacgacgcgagtagctcggcactgtcccggatcgccaaccacaagcgagccaagtacgaccacatcaagctacacctcgagcgccaaggatggaaggtacacctctcggcactcgtgtacgggtcgcttggggcggtcgctagtggcaactaccaggtgtacaccacacacctggggctactcaagcgcgatgcaaagcggctggaccggcagctgtctgcctaatgcatccagtccagccgccgcatctagaatctacactgcagccagcaccggactcgccaacaccaggcgaggcccagccaaggaccaagaggcagccgggcgacggagaccggggggactccgtcccagacaagccgccgctaggcggaaaccaggcccaagacggccgacagggccccacccaggtagggaaccgccctagaaacccatttcggtggtcgactcgcaagccttacctatattttagacgtagcgaccaaattacaaatttggtaacgagtaagccaaatggtaatacacaaaacttt

SEQ ID NO: 1329 - DNA, 415 bp, Phytophthora ramorum
tgatgcccgccaactacaaggtgcttactgagcaccttgggctgctcaagcgtgatgcgaagcggctggaccggcagctgtcggtggcgtgcatccagtccagccgccgcatctggaacctgcactgcgcgcagcatcgagcacggcagcaccagggccaagcgccaaggggcagtcgggcggcggagaccggggggactccgccacagagcggccgccgctaagcggacatcgggcccgtagcggccgacagggccacacccatgtagggaaccgccctctaaacccgcccggtacattatggtccgacacctatgaggtgcaaccggtacacaagttacacaccacatagcgactaccaggtatttactacctggaagccaaggattaaccggtcggtaatacacataacttt

SEQ ID NO: 1330 - DNA, 1562 bp, Ciona intestinalis
tagccaaaagatttggtgttcttggcgagctgcagtcccggcagagtaggcgagatcgtgagctctacaccgcttcacgatttgacgagttcttcttgagtcgatccccaacggcaacgcactccaaatttaacgaccgcatggcgacgccactgatctcccagtcatccgtgctccgagggcacttaaggggaaccgattcactgatgctgcaagttggcgggggcgcactcaccaatggaagatgagggagcccaacgatgccccgaactaccgcaccgtccccagcaccgtgtccttgtgagtaattattttcactaatccagggacggggccatgaactgaactatgtctgcacgctgccccgcctagcctcggccacaaataaatagtcaagccggggcgtactaccaattgattcggatttggcggggcccatcacgcgcctccgcccccacacacaaaaacacttttaaactcttcggttccccaaccactacaacaaagcgagcggcccctcttagatccaattttaaaattttaaatcagtgcactcaacttttttacgtgttgtgttttttgtattttttcccacagattttgtatttttatattatattttatatacacaacactatttttatacactaccttgcactgtcccactttttgtaattatcaccttttaccttttatgccgctcgctgagctccttgcacggatgaccagacaaacttttataaaattataacattgttttaattgtcgcggggtatcagtggcgcccccttgcggccgtgaaagcccttttcaccttaattcgccccttagtccaaatttttccccattgcctgtaaaagtgcgttgccgtcgactcgaactcgtcctttttaccgcctctctgttactgaactatgaccagcttggctgttgaagtcggctttaattcgccggcttcacattatatttttttgttgggtaatctgttttttttcatatataaaaccattcggcttaaaatcaccaatccccatcatccaccctggtcacccattgaaacatctctttttagtcaattattttttcagattacccctcccaaattgtcatatagtttaacaccccgtttgccaagttggtcttttccccatccccttctgtccttccggtaatcccataacattttattctttaattcggccccataaatagtgtaatcttaagacgaagtccccagaggcccggtcccccccttctttgtcatggaccgggccagcccccctgttaccacaacaacccaccattttattctttctttctttttattagtatttatttatattgccgcccaactgtcgtgtcgtggcgcaggggggttccctctgtcggcccagtggacgaccgtctaaaaaacaggcacaggcagcaggcacttatcacccggtacctccgggtaccggaggctggttttcagcgcactgtacgtgatggccaattttattcattgcattttatccgcgtcgtggtgtttgcgtggatgcattaataaaagatgaaattcc

SEQ ID NO: 1331 - DNA, 602 bp, Schistosoma mansoni
taacggctgaacgaatagcccccttcactcttagacattcccccactgttgttgcttatcttcatgctcttgtgttaattgactgctctcttctgggttgacgtctgattgtctctctctctttccatattgcttgctctgcccgcttacttccaatagttgtcatattatgtctttgtttacttgccatgtctaacgacaattactttatctaccttagtttgtcctcttggtttcgattgccttcatatgttcatggcggaatctgatgtttataatgactattcctattaccaccactacaactactattattattttcattactattaacattattataaacattattactattattattattactattattacttctacaattaatattatggctactcctctcagcacaccaataaaatatcaatcaaacatctcaattatatccacctattaaactctctctatttcccctgagttataaacttacaattcagtctaaccgaatatctctcttttacaaatcttaagtatgtaattttgtgccaaacccatttgggtctgtacaatttgatacttaaaaataaatgttattagcc

SEQ ID NO: 1332 - DNA, 90 bp, Bombus terrestris
tgaaaacacgataacgattatgaatcaaaataagaaagtaaacatcccagaaattgtctacgtcttatttgttatctatttatttgttta

SEQ ID NO: 1333 - DNA, 1815 bp, Crocodylus porosus
tgaatcccactctggggacccccaaaaattagaaaaacccaaaacagttgtgtttaagtgtgttcttgtttgtccctttggcttcacctccaagttgcgatcccccatctcccctgcgctgtctttctgaatgaccagtggtgttgaggctggtgtgacctcggtcacctccaaggccaagtgccctggccccgagtaggaccaggtggcccagcttgctgggcacccgtcaccgcccagggcaaatggaagggatctatcctgaccactaccaggctaagtgtggtgctgcctagcctgccgtaaggtcaagcgccctgctgccgctcgggtakcagtcctcgttcactcgtccctcctagtaccctccgcmtctgcgcttctgctatccactgtggccggwgatgccgaggwtgswmcawcctcgacacctccagggccaagcgccttggccmcaggtaggacctggcacctgcccagggggccagacactgcctgcggcaagggaaagggagccgtccctgaccgttaccgggcttgatggtgctggctagcccgccgtatgtcaagcactccacagctgctcgagttcgctggcttcaccttcatcccwcctagtgccttccgcctctgcgctattttcgtcccgactcgtacctccccacctctgcgctacmgctatccctgmaaggaccaagtgggcaggggsgttcgccccccgcccgcaggaggctcggcgtatccgtggcktcwtgcctccaccgtcttgtgccgctagaggggtacctcmgagaccggcgcaacacgaccttgacgsttagacagtagggtgmaacakccctgctgcaggcstgaagggccaaacggctgtgccatgagaggggaaccttgaagaccgggscagtcagccagttagtcagttgggcgaaacaatcccagctgcaggcccammagggctgtcaggtgagggggtatccccawccaccccccgccgccgactacggaggcakgaagtccctagtgacttckgacccccacgtcttgtgccgggagaggggaaccttgaagatcggggcaagccgcacttgatagttagccagtckggtgaaacaatcccagctgcgggtccgaaagggccgactwccaggcgaggggggcctgcggaaamccccctccatggtacggagktctggcgtcctmaccgacwccttgccaccaacgtcttgtgccgggagaggggaaccttgaagatcgggscaagctgcacttgatggttagtcagtcgggtgaaataatcccagcwgcccccgctgtgactgctaagmcwggtccccaaggggcatgaggcatstgcgctgagccggsaggggtgacacmcggcgatcggcgcagcacakastgaagggaggcacttgctgagactgcttctgaggccccagacttggggtggtgcagccttgtctggggtatggtacagcaccctactgctccctttggkcagcagaattcgtcccgacctcttacccacccgagtctgcgccttgttccgctatcctgcatctccgatccacctcgctgtctccccgctgcgctgcttttctctcaagtgggttaaatcttgtcatgattacctcccacgtttccgctcaagggcaatgcccaamatgacggggatcgctggtgcatggcagtcatgagaccatccggaccctccggtggtcgctatagtcattttktgttgcatggggcatsctgagtcacttaaccgaaagactcwaaataactcaaaagaggkamcctctgsggttcggtaaa

SEQ ID NO: 1334 - DNA, 236 bp, Drosophila willistoni
tagatgtactaacctctagcttttcttatacttttgcctgctaccttggcattacatctaaaaaggtacaaacatcgcattgtcataaagaggtggttttagtacgtaggcgctgtgggacttcattgtcccggtgatgcagtgaatcgtgcatacgagattgtccagtagttggttgctcgtatctttagaagatttccttcctcggcgatcaaaaaaaaaaaaaaaaaaaaaaa

SEQ ID NO: 1335 - DNA, 2018 bp, Gavialis gangeticus
tgagaagttgcgagttcttatgcaagttgaataccactctkgkgaccccaaaaaawwaaaccccaaaacagttgtgtttaagtgtgttcttgttcgtccctttggcttcacctcsaagttgcgatccccccatctcccctgcgctgcctttcagaacggccggtggtgtcgaggctggcgcgacctcggtcacctccaaggccaagtgccctggccccgagtaggactgagtggcccagctcgctgggcacccgtcaccatctggggcaaatggaagggatctgtcctgaccactaccaggctaagtgtggtgcggcctagcctgccgtaaggtcaagcgccctgctgccactcaggtatcagtcctcgttcacttgtccctcctagtaccctctgcctctgctcttttgctatccactatggccagtgatgttgaggttggtgcatccttggtcacctccagggccaagcgccttggccacaggtaggacctggcacctgcccagggggccagacactgcctgtggcaagggaaagggagccgtccctgaccgttaccaggcttgagatggtgctggctagcccaccatatgtcaagcactccacagctgcttgagtttgttggcttcaccttcatcccacctagtgtcttctgcctctgcactattttcatcccaactcgtacctccccatctctgcgctcctgctatccctgcaaggaccaagtaggcaggggggttcatccccctacctgcaggagactcagcatatccatgacttcttgcctccaccgtcttgtggcgctagaggggtacctcagagaccggcacaacatgaccttgacggttagacagtagggtcaaacaaccctgctgcaggcccaaagggccaacagctgtgccacgagaggggaaccttgaagactggggcagtctgaccatgctggttagtcagttgggtgaaataatcccagctgcaggcccaaaagggctgacagtcaggtgagggggtatctccatctgctccccactgccaactacggaggcatgaagtccgtagtgacttctgacccccacgtcttgtgccatgagaagggaaccttgaagattgggacaaaccgcacttgaaagttactcagccgggtgaaaataagtcccagttgcgggcccctcggggctgacagtcaggtgaggagggctgcaaagcccatctcctgactccagaggcctggcgtcctaaccgacttcttgccaccaatgtcttgcgccaggagagggcaaccttgaagatcggggcaagccgcacttgatagttagccagtcgagtgaaacaatctcagctgcgggtccgaaaggactgacttccaggcgaggggggggcctgcggaaaaccccctccatggtacggaggtctggcatcctaaccgacaccttgccaccaatgtcttgtgccaggagaggggaaccttgaagactggggcaagccgcagttgatggttagtcagtcgggtgaaataatcccggctgcaccctgctgtgactgctaagcccggtccccaaggggcatgaggcatgtgcgctgagacgggaggggtgacatctggcgatcagcacagcacagactgaagggaggcacttgccgagaatgcttctgaggccccagacttggggtggtgcagctttgtctcgtgtatagtacagcaccctactgctccctttgggcagcagaatttgtcctgacctcttacccacccgagtctgcgcttttgttccacctcgctgtctccctgctgtgctgtttttctctcaagtgggttaaatctcaacatgattatctcccacgtttccgctcaagggcaatgcccaacatgacggagatcgttggtgcatggtagtcacgagaccatccggaccctccagtggtcgctatagtcattttgtgttgcatggggcatgctgagtcacttaaccgaaagactgtaaataactcaaaagaggtaccctccggggttcggtaaa

SEQ ID NO: 1336 - DNA, 437 bp, Ixodes scapularis
tagtgtgacggagtcctcaagcccccacaagtgcctgccaggtggcaggaaagggcaactactggtgagcgacccaagcaaggcggagccaagaccaagctggagccaagagcaactccaggaggcaggggtggatatcaagagcaaccccaagggacacagaccacgggcaactactggtgagcgcccaagacaggggtggatattaagaacagccccacaaagtgttacctatattaacaataaagttgaagcctcaaccacgcattgcgggttagatggcgtggcttggcccgccgccatgatgagctggaaccctccacctggtgggccgcacgagaccaccggctctttctactaaggccggtctccgtgactgcggttgggataaactccaagcactgagcggtaaaaaaaaaaaaaaaaaaaaaaaaaaa

SEQ ID NO: 1337 - DNA, 970 bp, Mnemiopsis leidyi
tagtgacgagaaaagtcgctttatccttacataacagtgtgatagtcatccttatcacaactgtcctggcgaacaaaatggcagagggatagtactcggtccaaccagaaggaagcccacacgatgccaaacttgctgtaacccacgtgagcggaaaacatcctccgagtatagtatgatggaaggatacaggatgtggaccgctctaggcggcggacggtgtagacggcgaccttaccatagctgcgactgctgtgcgatccggaacgggcctttctcacttacctcaagcaccgtgtcggatcgcggggtgggcgcgggattcctgctgggaagttgtctgcacccaagtcgtcagctaactgtcggtacttatacgcacccagagccatgctcttaccaggccacttgacggcgctacaccggtctgtaggagggtatctcagcgacttggacaaaatggatcttgactgcctgagggcgcttatcgagtgacccagagtaagctggtaggaagaatcttgcagttgagagggctagtagggccagcctctgctcgtcaactgtcctaggcgttaacgtgtgcctccctatgaggtaaccgtgaagtattacttgtttccctgtagagaccatataactagctgagaaacgccctgcgggttaatatacagttaccgccgtcctgcatccccgagttgtgaccagcgtacagccatgtaccacggcacttccagcattctctggtctaagaatgtatcagctggcccgccgaaagatagagcgaccccgcctctatcactagagtaagcaggcacgcgaaatatatgcaggacgccttggctcagtagctctggtactgagtatagcatggctgaacgcccctttaagttcggtggcccagagactctccgagacttcccagtcctggagagggtacacctttaccagaactttctgtggtcggttg

SEQ ID NO: 1338 - DNA, 153 bp, Petromyzon marinus
taatttaaggtaaaatcgtgggattgttttgatggcaatctgcctagtcgcggccttccattttgggtaggcagcagacccatctatataacaaactactttgcctttcataggggtacccgaccctaccaactttcggggaagtaaaagaaa

SEQ ID NO: 1339 - DNA, 1231 bp, Schmidtea mediterranea
  modified_base (260)..(260): a, c, t, g, unknown or other
  modified_base (446)..(446): a, c, t, g, unknown or other
ggccacgcgcgtcgtccttgtttgatcactagtggatcaaccttcgactccccggaactgtgggagtggcggaagaaaggccagaggatgtcctgaaaccatatatttatttatagaagttttacttcatcctatttacgtatttcagtatgaaaatgagtaaagttctcgactcgatgagttgggggcaaccattgggggtcctgaagagaggctctcactgtaaaaaatctcttcgtgtctgtttattcctaggcacntgctgcattatgaagcggwgaaagtaaagttagagctgagagataggtacttgctgcattatgaagcggagaaaggcctcgaataaatagggtgttagagttattgatggagagtatactagtaagcttaagctgcgcctcgcgcggtgcccaaaaatatacttaatgagagcaataactcaaggngagtttaattcatatgcgcatgcggcaccaaggtgctgaatggcatcgattaaacctctcctgttgtagaagcaggtcataaatggaggrgggcaaccactgaaacttatgagccagaagaagcttaactacawaagttttaggcaattactgaacggagttaactgttagttaacactaccatgtagttgtttataaagcaaatatcaggtttcagtctatatactaaaagtattttttgataccgtggtatataggcaactagttaggaaatagtaagggatgacgcattgtctctctttatggtactgaggaaacttatcgactcgcgagggatgaaacccgtaaaccgatcgatytagcctataagtaccagcgacagttaaaccatcttacgcgaggggtaaaacctgaggaccgattatggtataacttctcaagattagcacaaaatgcgagtgcaacttgaggaggaggatttgagtgttaattcataatgtactaatctaattaaactgtgacgggaattgcagcttcggctgtaattactttgaggcctatcacggattgtaaggaacatattgacaccgtaagtctaacgtgttcccgatttccaaccaggtcatatgaagggctgcccttgataaggcggatttgacccaattcttcatatgagaggcttattccagccttcccgtagtaccgtgaggttttcccgcctcgaacggaacaatgttgcagggtaattaagtacatcgggctatatmgcgatatttaacgtttta

SEQ ID NO: 1340 - DNA, 813 bp, Strongylocentrotus purpuratus
taaaccttgcctccccgggcccccctcagtgactaagacaactttcaccgtaataatcatatatttgtataccatgtattaatctaggtaacaattgaaagtaacattgaaccgtattcatactttaatgagtacaatagtgaagggaactgtatattacatacctcgagatagaggtttttgtaccttaagggttcgtgagaatccatactgcataaaggggttaacttgtaactcaaccccagggagacaagccgacaaattcggcattactatgtgagggtcataagtgttaaaggacccattgtatataacttgtaaatgtacagagaattcgagttgagttcgaagaataaacaaacaaaaaagaaaacaaagagaattcgttcgtccatagaagcggaaaaagcgcaaaaaggcgtcctaacctcacggtctaacccagaaacatttaaggggggaaggagctcattactccaatccaaaaccacgttccctagcccaaaagcgcgcttcaatgagggagccgatattggaggacagagttcatcaaaagccacctgtaagtaggcccatttctgccaaggacatgcgcaaaaggaagcagattatcaaaccagtcaaacaagcacaaacattggggggatgggataaccccggaaagagagggatctttagatagtggatggaaggggtgggacgttgaatccaaccatgccgtttttatgttcccgataaagaaggataaggtcactccagcctgacacacaaagtggggtaaaagaactccgctcgtacggactccaaatagaa

SEQ ID NO: 1341 - DNA, 2663 bp, Salmo salar
tagatccgtttgttatgattggagggagcctgccgagtggtatgagcgctccaactattgaacccatatgattcccgaggcctggccagacgcctagatgcctgccacaattgaacgcagccctagcttgctaggagatccataggaactggcctatggggcgtcatgacggttgaagttcctccatagcgtgcttgggaggggacgacaatgacgagtcatgacgtaccgagagaaccccaacccaggttgggggagagagccagcaagagcggagatgcttggtataccaagctagcagagagagggttgaagaggatgactactgggctcagagtcatctcaccctaaaaggcggtggggcatcggttgaacacctacccataccgggatgggaggtggtaggccgaaaaagaacaggaagatggtggagtaagttgagagcggttgctcgggaagttatgttgtgataactccattaaggccggtgggcatggtgcggataatggaaactataaaaacaataaaaagaaagaccaaaaaaatgttctgttatgatgccttacacatgtctgggagaccccataagggtctccccttatacttcactgggaaaccccataagggtatccccctatatttactgggagaccccataagggtctccccctatagatgtagagcgtaaggggtctccaaagtaccggccgatatggccttatggcaaactctggtggtagggacaaggaggtaagggcagtgccaacccctacttgatcgggaccatccagggaatgccatcctcccgcgaaggtgatgtggtgaggtaaggggggagcccgtcttcgagtttccccaacccctacccacaggtgagaggaggagaagaggaatctgtccccaacgggaggagggtgaggtgtaagggggagaccttctagtagggtcttctcagtcgcctgacgtcctgactgtggggtggatcagtaccctacaggtgagaccggtgaggtaagggtgtggccctcttgagggctgcgccaacccctactcgaggtaacctgagggagtggtggaatggcggcatgttagtgctgggacttgattgcgagggtttaatgagagtggcctgctgagagcaacacttgtggtgcttaaagcggggcggcccatgaccaccgtgagataggacactgcacagtgcagccatgaggttcctggaggatgatgcgatgaggtgggggcctcatcagcccctcctggcagggcgtcggccagggaaactaaatgtctctagcatgtcagtgcagtgaggtaaggggagagcactctagtagggctcttccaacccctacctgtaggtcacctggtccaggtgtcgatgatgtgaaaacaagagctactttggtaccggtctgttgcaaaaagggttctgcagaggacgacggctatccctatcgggagggaatagtcggtcccaggtagtggaaaatggggctttccactgagcatgaaaatgtggtagaggttgcgtccaacccaatgatttgcagcagagctcttggacacgaagtctgtatagtcccatgcaggcagccaaccagagaatggtggcaagaccccagctccgtatgggaggggagggccaagatatacggaacggctgctaaagcgttctgccggtgtcagtctaatcacagacagctgtgacgaaacaaagtatgggttccgacatgcttggtcagctcttagccgcaaggcttaaatcgaacgcagcccgccgagagtgaacattaaacggggatggaatgtgtctagcggttacgtactaccagggctcaggttcgcctgagccgaggctctacacgtcatggtgggagttctccccacgctcgtgagggcatgtagtgggatggcatgtggcggaccatcagctggcactaccaggcctcgggcttgcccgagtgcgggacctcacacattgtaggtgtgcttgtcccccctacgttcgaagacttgaggcggagaatactcataggccccacggcaaagggacacaacacggaggcttgtgtccgacgagccgtggactcctatagacagcccgggatatcactgggcacgctcatactgaagaaattcgatgaaccgggcctaccggagcaaatgcactctaatcgcctttgtgggcgactgtggccccctcatgcgagtgaggaatatcataaactgcaatggttcaaaaagtgattcctatggctcgtcggggagggctgactggggcaagcaaatgattgaaaggggaagaacctttttcaactgtttcttgccaagcccggttgatggtggcgctagtaattgcgacgggaaaatgcggtttaagtctccgaagtagtgcgtagcaccggatgtcgaccgggtgtaaaagcccttcgtaaagtccctggggaggtcagtcctggggctactgatgcgcagtatgtaattcgcagaatagggccatcgataccgcctgcgtgactcgactgggtttccacttgaggatatccgaccgtagcgtgcaccctcttgtagttgcgccggaaacggctgtgttccctcacgtatgtgaggaaactcaacaatgtgagtgggtaaacggcgggacgaactatggctctcgt

SEQ ID NO: 1342 - DNA, 155 bp, Tribolium castaneum
tgaaaagagtggcagttgtggagacttccttcggacgtcgggtcggattttcggacgccagggtacctccaccgctgggttcacaaactaggcgaacatctgccgataccctctttaggtcataggaccacatgtctctgcacgagattaaccca

SEQ ID NO: 1343 - DNA, 398 bp, Tinamus guttatus
  modified_base (100)..(100): a, c, t, g, unknown or other
tagggggcttggcatttctcattgcctgctcctgaaaggatatgggtcctgcgtcgcgtggtaggcagacccattcgtccgagtagggggcttggcagtntccattgcctgtgcccgaaaggacgtgggtcatctggtctgtctgcctacacctctctagacttgtaacatctagtctgtcaacaagatcaaaattcttcacacagacgaccgagcttgctcagtcttcctgtacccgcagaattttgctcttgctctcctttggctgtgtcctggacgtgggactattccatctcgtcccaaatgccgcgtccaattataccggatttgacaaagcggacggcccgctttataagccggaaaaggtgccttgtaaaattgcaaggttcattaaatag

SEQ ID NO: 1344 - DNA, 304 bp, Trichinella spiralis
tgaggtttttgttttcttttttccttttaccattcttgttccattgttgttatttgctttaatcctgtattttaccgccggcaattccattgttattattactgttactgttattattgttactattgtttttacttttacttactactgttattatactttaattcgttaacttacgttattgttaccactacttactttgctctctcgcaaacgttcgttgttgtttcttttggaccaggtttagagaaatcgcacgcacagcggaactggaccgcttaagccagaaatagtaaagtaacaa

SEQ ID NO: 1345 - DNA, 155 bp, Tetranychus urticae
tgatgtatcccttcaatatattgtaatcctcattcgtccctatcctttcatttgataaaagaaactttgttgctccttttaatagttggtccctcctgtcccttttctggaacctggttgtatcgattattgaaagttgcaataaacggatttaa

SEQ ID NO: 1346 - DNA, 235 bp, Drosophila willistoni
  modified_base (217)..(217): a, c, t, g, unknown or other
tagatgtactaacctctagtttctctatacttttgcctgctaccttggcattacatctaaaaaggtacaaacatcgcattggcaaaaagaggtggttttagtacataggcgctgtgggacttcattgtcccgatgatgcagcgaatcgtgcatacgagattgtccagtagttggttgctcgtatctttagaagatttccttcctcggcgatcaaaanaaaaaaaaaaaaaaaaaa

SEQ ID NO: 1347 - DNA, 162 bp, Petromyzon marinus
tgagaataatgaggtgctaacctccctgggcctgaccaaacccagaacacatcactggccaagatgatttcccgcagcacgttgcttttctctctcgatacccgagaatgttctgcggaactacgcagtctatgaacagtcacagacaacctctgatccaag

SEQ ID NO: 1348 - DNA, 257 bp, Schmidtea mediterranea
tagaagggaaacaaaggaaaaacgaaatgactggaaactatgaaggatatagctgaaagccgcaaggaaggctaagtcctgaaaccgatctacatcttcgatcccaagaggaactgtgggttaagcttgagccgacggaaaaagcgaatgcatgttagacgacgaggtacagtcacctcctcgtggtatttggcgggcaatgctcactaaattaactgtgagtagctgagaactgtatgtgtatcatgaaaaaaaaa

SEQ ID NO: 1349 - DNA, 233 bp, Tribolium castaneum
tgatgctcctttggttttaccatctgtgggggcatcggtcctcacggtttcctcgggtttcctattgtttttcctaaacccgacaaggagccctttggccctcctccttaaacacctctccttcatcctsttagtccattccggctaaaatgatgaagaccgaggagtgtcactctcttggcggggttaacccgtccaagtgtaaatgtgacctcgccattcgggctctgata

SEQ ID NO: 1350 - DNA, 214 bp, Megachile rotundata
taaatgtcgaaccgaattttgggtaacgtgcaccccaccatccttaatcggcagcacgcaataaagccgtgggcagtggttttagtgggtagtcattaggagtcccacagtacccagcgaacatcttagtgggtctgcgtaaacgcatttccactgcctatcctccgggaaaaaaaaaaaaaaaaaaaaaaaaaaaaaaaaaaaaaaaaaaaaa

SEQ ID NO: 1351 - DNA, 508 bp, Apis mellifera
tgatcgttaaaagtaaaaatctatttatttatttttattcctatattataacacattatttatttatttacttattgttttaaagatgacgaagccgcaaggccaatccaaatttaacaaaagaacgagactactggtcgacattaaaaagacgaagcagctgccagctgataaacaacagagcccgtctcggcctttacaccgagcggtgcaagtcctgacgtactattgtacgtctagggcgcggggcagattctaccgtgtagaatctggggcgacgcctccgcgaggcactccctggacaacgtacgctaaagcgtacggctaagtgcgcctcccgaaagggtccccgttcctaatttttccgagcccgcgggcagatctcgtggcagtgacgctagaaagttaagtccgcggacatataaaattacagccttaaataatgaaccccacgaaggaggtatcctcgaaattccgccacgatccttctgatcgtaggcgcaaaaca

SEQ ID NO: 1352 - DNA, 696 bp, Nasonia vitripennis
tgacctgaacaaaacgtgttgtcttgtcttgtctaaaactatttattcgaaataaggggaggctaactgcctgcaagttgaacgcgaaagttagaccttcccacctaaagcccaaaagtgatcggggaatgaatccgcgggtgaccccagagttgggtaaacccttgaaacgttggagaagcggaagagagtcccgccaccgagcatcgagtgctgcggcgcccgaatgaaaccgatcgcggatggtgcaagtcgtaggacggggcacgacctaagcctctgtcacggcggcgaagccaggaatcaccatgcaaaggtgtgaactggggcggatacctccacggggtttccctgggcatcgcgcgagcgatggccaaagtccgctttctcagctacaaaacaaaaatggtatgagacttcgttaacactaatttttccgagcctagcaggctcccttgacaacgcttatgaatctggaaaaggacacaaagtggaaaaagcgctgatggtggacaaaagtcagttgagacttgatatcagttgttttgactaagaattttattatcgttgacttttaaatattttattattgactgttaatatactgacttgggaccaagtcatctctgttacccggtaccggttcctgtcatcaaaccggaaagtccgtcccacgtaatgtggtagacgcaggag

SEQ ID NO: 1353 - DNA, 122 bp, Ciona intestinalis
tgacagtaatatgaaaacatcacatctgaccggcacagaatcaccatgccgtaatgcacccaactaaggattccaatgggtaaaaaaaaaaaaaaaaaaaaaaaaaaaaaaaaaaaaaaaaa

SEQ ID NO: 1354 - DNA, 112 bp, Nasonia giraulti
tagcggactggactgtctggaggagtgtttaactcgggttctcatgggaacccgacaacgttgttatcttgtatgacaattcataaaaaaaaaaaaaaaaaaaaaaaaaaaa

SEQ ID NO: 1355 - DNA, 345 bp, Lepidurus arcticus
tgataatcgctccatcctgcaactaattatgaatgcaaatctgttaagtgacattagtgatacttacctgatacttaccctggtatttatttgacctatacttaccctggtatctacctgacatatatttatctaaccacctacctatgatgactcccgcggaaactctcacttaccttattacccacttggtcttttattttctcgttccttattactttgttcctttggtgtagggttctctggtttttggaacggcttccttagccggaattttgtctgatgtatcttgcttgtgtccttgaaatatacgacccaggcttgcgtcatttaggctctgggaaa

SEQ ID NO: 1356 - DNA, 380 bp, Lepidurus couesii
tagtgcttgagtgatgcctatcctttctttgattaactcttaccatatacttaccagttcttacccgtacttaccctgtatacttacctgtgtgcgtacctgtgtacttgtcctttagccgccttgtgtttttaccattggtacttaccttgtgtggttgcccgatacttaccttgtatttgccttgtaattctgcatgatatttattgtgtaggttcctgatgcttacctgatttgtccccctcatcatctttagtttcgttctatttcactccattatggagttccgtttgttttttggtggaggtacagcaccctttaagctggaattgagtgagtttatgtactttggatggttgtaataaactacccggaggcat

SEQ ID NO: 1357 - DNA, 345 bp, Lepidurus couesii; identical to SEQ ID NO: 1355

SEQ ID NO: 1358 - DNA, 324 bp, Nematostella vectensis
tgatggtgggttactcgcctctgtgtaacaggcaaatgaaagctgcgcaagcagtcgatgagccaaagccgcacagcccccgactggggtacagggcagccctgggctatgcccgaagtcttttgacaggtccaaacttcacccttgccgccagtagggcaccagggccaggtgcaggtgggcgctttgttctatttggtttcgcttaatttttgttaaatttttcccgtgcgcccaccctttttaacccttttaacaccaattttttttacaaccctctactcaataatccaaatgaataaaagcggcataacaggtgaacac

SEQ ID NO: 1359 - DNA, 533 bp, Schistosoma mansoni
tagcccccttcactcttagacattcccccactgttgttgcttatcttcatgtttttgtgttaattgactgctctcttctgggttgatgtctgattgtctctctctctttccatattgcttgctctccccgcttacttccaatagttgtcatattatgtctttgtttacttgccatgtctaacgacaattactttatctaccttagttggtcctcttggtttggttgccttcatgtgttcatggcggaatctgatgtttataatgactattcctactaccaccattacaactattattattatcactattattaacattattattacttctacaattagtattatggctactcctttcagcacaccaataaaatctcaatcaaacatctcacttattaaactctctatttccccttcgttataaacttacaattcagtttaaccgaatatctctcttttacaaatcttaagtatgtaattttgtgccaagcccatttgggtctgtacaatttgatacttaaaaataaatgttat

SEQ ID NO: 1360 - DNA, 314 bp, Triops cancriformis
tagatgactgccctacccctttgctgccgaagaactactgaagactattgaactaaccaactgtgttaagtaagaactaatgcctctttttccctgcatgtatcccctgatcagtgacttattttcttttcctgttgcgccctttgtttagttatttcctttaattactagaattatcttttcgttctccgtctaattgctttttcggtgtaggaacggctacctaaagctggaagtgggaagtgttttcaatgtactttgtgattatagaaatatatgacccgaggtgcattgtttggcatttcctcgagaaa

SEQ ID NO: 1361 - DNA, 256 bp, Drosophila ananassae
tagccaatgcacgggttccagattaagcttgctgccgaagcataccatcaaaatcggcataaaattcgcttaataaaggaggtggttttagtacgtaggcgtcccgggacttgtctcgggatgaatcgtgcatgcgtataattgggatcgataacaaataccaactaagttattactaatatatcgaaatacataaatatcccgtccttacgtatctttgaagatttccatcctcagcgaacaaaaaaaaaaaaaa

SEQ ID NO: 1362 - DNA, 256 bp, Drosophila melanogaster
tagctaaatcgtttggttcaaaacatttgcttgctgtcttggcataacatcaataaaggcataaacatcgcaaaataatggttataattaaatggctatgaggatggttttagtacgtaggcgttgcggaacttcggttcatatagagcaatgaatcgtgcatgctaggaaaactgaccacacacagtgttggcagacctagtatctttcgaagatttccatacctccgcgatcaaaaaaaaaaaaaaaaaaaaaa

SEQ ID NO: 1363 - DNA, 203 bp, Drosophila persimilis
tagcctatacactatgttggagagaagacgcttgctacctaggcaaaatgtgaaattaggtataaacatcgtggttgtaaaacttgaggtgggtttttagtacgtatgcgtgattacttcgtaatcatgaatcgtgcatgctagtggggtttggcctccactagtatctttgaagattttccttcctcagcgatcaaaaaaaa

SEQ ID NO: 1364 - DNA, 219 bp, Drosophila pseudoobscura
tagcctatacactatgttggagagaagacgcttgctacctaggcataatgtgaaattaggtataaacatcgtggttgtaaaacttgaggtgggtttttagtacgtatgcgtgattacttcgtaatcatgaatcgtgcatgctagtggggtttggcctccactagtatctttgaagattttccttcctcagcgatcaaaaaaaaaaaaaaaaaaaaaaaa

SEQ ID NO: 1365 - DNA, 247 bp, Drosophila sechellia
tagctaaaacgtttggttcaaaacatttgcttgctgtcttggcataacatcaataaaggcataaacatcgcaaataatggtaatatataaattggctatgaggatggttttagtacgtaggcgttgcggaacttcggttcagatagagcaatgaatcgtgcatgctaggaaactgaagtgttgacagacctagtatctttcgatagatttccatacctccgcgatcaaaaaaaaaaaaaaaaaaaaa

SEQ ID NO: 1366 - DNA, 258 bp, Drosophila simulans
tagctaaaacgtttggttcaaaacatttgcttgctgtcttggcataacatcaataaaggcataaacatcgcaaaataatggttatatataaatggctatgaggatggttttagtacgtaggcgttgcggaacttcggttcagatagagcaatgaatcgtgcatgctaggaaaactgaccacacgcagtgttggcagccctagtatctttcgatagatttccatacctccgcgatcaaaaaaaaaaaaaaaaaaaaaaa

SEQ ID NO: 1367 - DNA, 242 bp, Drosophila yakuba
tagcttaaaacgtttggttcacatacatctgcctgctgccttggcacaatatcaaaaaggcataaacatcgcacatattggttatttacggctatgaggatggttttagtacgtaggcgttgcggaacttcggttcggatagagcaatgaatcgtgcatgctaggaactgaccaaataacagcagccctagtatctttcgaagatttccatacctttgcgatcaaaaaaaaaaaaaaaaaaa

SEQ ID NO: 1368 - DNA, 221 bp, Kalotermes flavicollis
taatgtcccttttggcttgcccccacctgcttaaaggaactggcaggaaagagagtgatccgtgccatagaaatatggttatccggggcaagtcactagcaatatgggacttctccgggtccgtgcggtccttccaacatgagctggacgtagtccactctatgacttgaacgatacgggggcgtatctcccccggaagaggtcgcctaggcgacttagaa

SEQ ID NO: 1369 - DNA, 289 bp, Reticulitermes lucifugus
tgagttagatatatatgacgactgattcttccctaactaaaatataatttggaatgtgcattacttatactttattgtatttattgacatccgtagtagtctgtttagtggatttagatcgttaaccattctgtgacgtcgctgatgtctatatgtaccagtggcagaatgctgactaagaacaaaataattttaaacaatagacagcactaagaaattctgcaaactggaacgtggcccacggtaggccaatataccggaaagggaaaatgacacatccccccttaaa

SEQ ID NO: 1370 - DNA, 289 bp, Reticulitermes urbis
tgagttagatatatataacgactgattcttccctaactaaaatataatttggaatgtgcattacttatactttattgtatttattgacatccgtagtagtctgtttagtggatttagatcgttaaccattctgtgacgtcgctgatgtctacatgtaccagtggcagaatgctgactaagaacaaaataattttaaacaatagacagcactaagaaattctgcaaactggaacgtggcccacggtaggccaatataccggaaagggaaaatgacaaatccccccttaaa

SEQ ID NO: 1371 - DNA, 312 bp, Rhynchosciara americana
tagaaatgtgtgcgataaggtgtgaatagaagggttcaccaagagggagacctagtttggacctcagaaatggggtcataggagtgataggttgtaaagccgttggggaatccggctacacatggtatctcaggagccattcatgcgctgatctcattaaggcgtaataaactgtgaaacagatcctgataatgccgtgctaccaaatgatgtaacgaggcggaaataaaattaatctggggcgttctgcggaatgactactaaatatagcgatgctatatatacaaacgactgatggtaacaccggcctta

SEQ ID NO: 1372 - DNA, 1206 bp, Ciona savignyi
  modified_base (1079)..(1079): a, c, t, g, unknown or other
  modified_base (1181)..(1181): a, c, t, g, unknown or other
taagatccgcggctgtggcgccgaacgagcacctgcccattcttcttgtagggactttttcaccctcactccccccaatagttttttttcgttttttcgttttttcacccccaccccactcgcctctgggctgcacatcccacacgtagggacctgtttatattatttgccttttatatgtaccactttttaaatatatttttgtaccccacaagatgcttttcgccaaaaaaaaaaaatttttgtatcacatttttatattttgtaaaacacagatttttataaactttgcactatttttatataaacttcgcacttatttaaaatgaatcgcatcttttttatatacaccaacacaaacaggatgtgcagctcaggggaaccaatcctgcgtccctcctagcggcgggaggggcgcccacctacccccacgctcctcttgagcaccaacagggactcccttccggagcccctgcaccctcaacttttcttatttttaaaaaaaaaaaatcatatatattgatcttgacgacgggggctacattcagcccccaaaaacccacccaccatccccaacgagtgccggggcattgaagagctccggcacaattagcacttagcttatttattattttttgtcaacatttttgttttttcaaattttttcacccctcacccccaccctaataggtccctcgggcttgggcccctttttcgtgctcgagaagcgtcacatcgccccactgaccacgaccttccccgacattggagtccttggcgtctcccaggtcgaaacagtcccaagtgatagcacctaatgctcgacttgtttcggcctgggccgccgaggattcccagaacgaccattcttctaaataatatttatatttcagaataaaactatatatatatcgttggcgggacttgtcccgcctcgataccgagtgctgcagagcggcaaaataaagaagaaaccgacgtcgctctgcagccaaggaccacccaaactcaagccagcaccgtcgacaaccaacatcctcaagtcggcggttgctggaacaactcataacatcttcaanataaattatcaccctgtgcagcaggaggccgtgcttttaaaactactctgtagtggctcatgataatatttcgctccttttttgccccgtgtaaacttagtngatgcgaataaaatcagttgaatca

SEQ ID NO: 1373 - DNA, 128 bp, Bombyx mori
taaaaactagcataattattaactcataactaatgtatattacttggccaaaagcccgtatatacagttccaccggctctgtcgacagactgaactgagaaaggggaaacatatggaaataataataa

SEQ ID NO: 1374 - DNA, 204 bp, Anopheles gambiae
taacatccggtgcaaactcattaacattaagaaaagagagaggagaaatgagaatgagattcattcacctttggcatttgaatagcccggggtaggtgaaaagttcccagcatattgctgagaagtgacaaaattcggataataataataataataataataataataataataataataataataataatatgcataataata

SEQ ID NO: 1375 - DNA, 474 bp, Bursaphelenchus xylophilus
taagaaaagcatgaaataataagaaatcagataagaataacaagaatactaataagtatatcatgtaactatgacaaaaagaacgcaccaataagaacatgcttgagtggccagctctgcaggcaaaagtcgaatttggaacagccggtaatggaagacctgcaacaaacgtggggtagcaggcaatatgtaactatgacagaccaaaactccgaaactctggtaatgagcccgtgccccccaagcatgtggtctcgttcgatgtagttaggaacagttctctttaacccgtgatgattacgccctgtcttaaatggcaggtgccaccaaataccgaacactcgttgaggtatggtggtccgaatgtgaagctgggagtacaatttggtacgagagcaccagcgcccccgatctaagtgatgacgcatgcgtcggaacaatgaagacggctggcaaacattcaggagtcgcaaa

SEQ ID NO: 1376 - DNA, 31 bp, Heterodera glycines
  modified_base (11)..(11): a, c, t, g, unknown or other
tgaggactcanaattgacaatacacctcaga

SEQ ID NO: 1377 - DNA, 106 bp, Parhyale hawaiensis
tgagccttaggtcgcgggatgtgacccggcgccagagtgtagagctgaacatcgctcaaccgatccaatttgggtcgtgaaatcccctcgataataataataataa

SEQ ID NO: 1378 - DNA, 651 bp, Bursaphelenchus xylophilus
taacaagtgtaataaaaaccacccatgcgtagtaaaccgatcaattatctagcaaaatcgcaggtcagaagaccaaagaaccgacccagaggaataggaccagagctgaaactctcagatacgccaacggtcctaataaaacgtcgttaagtaaagcatcgttaagtacaaaacaaaagcactgtaaacgcgaggccccctctttgccaaactccggtaatcctcgtagtacggtgctttttcccgcttcacgaatcagaacgctgccagatcttgtccgacatgggccgtagggtttgggagtaccagcgtggggcggagagcgtacctgggtacactgcataatcgggtctcagaaaaccacctatggtttattattctgtctcccatctgcagggtagcttttcgttgggccataggagcctaggggcaagagtgcatgtagtcttcaacggccatgccagggaaacttgtgagaggtgagggataactagcatcagataatatcagtcatgaaattagtaacaaccaacgttcaccgtcgttggcaaaacaccgactaacgatgctagttagaaagagtcgggtcttcccaaagttaggtgcttgcaccgaagccgatccgctctacccacagctctgcccagcgtt

SEQ ID NO: 1379 - DNA, 406 bp, Heterodera glycines
tagtcgtagcccagatgtcgacagcccctacaccggtagatggaaggaggtatgtatctaagcccacggcaagccaccagtggaaacggtgaccacctctgttcgcggaaatgccccgtagagtatatgaaggtcggagcattgaagcacaagtgagaaccctggaagtatggtggtgagctggtaacctcgaattcctcctatgggtgcttgcgcccgtaggtcatttgtgtatgtagggatggaaggaatctcgatagcgcaaatcgggataccgcactggcgatcatgctgccagtgggccctgctgagttgggcgggttagcaacccgtccagggacgcagatgccaaaagcctggtgacactctaaagggagtctacggcgacgagaacatcccctaagtc

SEQ ID NO: 1380 - DNA, 99 bp, Strongyloides ratti
taattagatttatatgtgccactttacctcaaagatatattaatactaacttaattataatttattatgaattataatataataagttttaaaataaaa

SEQ ID NO: 1381 - DNA, 587 bp, Bursaphelenchus xylophilus
tgagaccacccatgcgcagagtatccgaatcagtgaaagtccaagtttcaggacagaaacgtcagataagtccaagagaaacgagaaaacaagttcaagtatgcaagagttaatcaataagagagtaccgtaaatgtatgacccccccctttgccaagtcgacaactgtcatgcaggtgtctctcttttcacccgccatatggaccaaacgctatccagcctcgctcagaagagccttagggctggggagtaccacatgtggcggaaactgaatctggatgcgatgcataccgggagcgcagcgaaatcacttaacgctggtgcacctcctgctatcgtagtacttcctagatagatgagtagggtgggctaaaggtagtcgtcttcaatggcaataccgaggggtctcgtgacaggtgagggataactagtatcagataatatcagtcatgaaattagcaacaaccaacgtcaccgtcgttggcaaaacaccgactaacgatgctagttagaaagagtcgggtcttcccaaagttaggtgcttgcaccgaagccgatccgctctacccacagctctgcccagcgtt

SEQ ID NO: 1382 - DNA, 364 bp, Bursaphelenchus xylophilus
taattaggcagtgctcctagcggagtgccgtgaagtggtgtcagtacccgtcgtgtggaaagcccaggagggttagtaccgacagtgggaaacccgctgcacgcaacctaaagacatttgcccttcgggggagaggtatgagaccacactagtcatggttgcttgcgcaagcatgactcattcattgtaagttcgtattatgaggcctcgcggaatgcgaaagtccaagagcgccaacttgtctctttgggaggttcctccgggttccttagggttggcgtaccatgcttcgtgtgagacctaggccgcttggacctagagttaagctgttgcatgtttgaggatgccttaggcggacgccatg

SEQ ID NO: 1383 - DNA, 177 bp, Ascaris lumbricoides
tagtcgctaaggggtccggaaatggtccggtcctgcgctacccggttctggtagcacgttcaagcgctcaatcgcctgccttgtaggcagtccatctgtggaagtcgcgctcttgatacagatgtggacggatggaagcagatgatagagccggtgacggccctactagccaaacgc

SEQ ID NO: 1384 - DNA, 160 bp, Heliconius melpomene
taacttattgtcagaattccttactagtaataataattatcgctgaaaatctccacccaaatattgcttggctatatgctcgcaatttttggttaacgtaccccaatgatttgggagaacaaaaatggtaaaactataataataataattatattaatat

SEQ ID NO: 1385 - DNA, 84 bp, Takifugu rubripes
tagaggacccgagtctgaaggaaggaggcaccgcccaggagggcgaggaagagatttttttttatatatatatatatatatata

SEQ ID NO: 1386 - protein, 1365 aa, Geospiza fortis
VGLCPSPGVDGTHQPNDSFQNFGETNFSVQVARLVTRNLAPRSVRGNGFGSGMATHPVPADESGHESDPFLVGRSCGQPARLTRQSVGTQTSRDDILPSKTTKLTENELDLLVNFSLELYRSDLQGFVQEGIHFSVNREVLEGFPEVYEQPAPQPAVGDDLNTSLPPDNNICVLEKGSSEAVEDGTPEVAHPVPETQGKESPNNIVMVTLPNKNPPCPCCRVRLHSVLALIEHLKGSHGKKRACFRCVKCGRENFNYHSTVCHIAKCKGPKVEKAPVGEWICEVCGRDFTTKIGLGQHKRLAHPLVRNQERIDASQPKETSNRGAHKRCWTKEEEEMLIKLEVQFEGHRNINKLIAEHLTTKTSKQISDKRRLLPRKQLTDLSKGVAGQKVLDPGLSHQPQLGVVDNGLGGGHLPGGPAAEGRTIEPLGHHLDKDNGHREIADQHKAGRLQAHYRKKIRKRLSEGMISNFPEVFEQLLDCQEAQPLINQAAQDCFGCLDSASQIRKALRKQNTQKDQGDQPKRPAQKWMKKRAVKRGHFLRFQKLFHLDRGKLAKIILDDVECLSCDIPPSEIYSVFKARWETPGQFAGLGDFEINRKANNKAFRDLITAKEILKNVREMTKGSAPGPDGIALGDIRKMDPEYTRTAELFNLWLTSGEIPDMVRGCRTVLIPKSSKPERLKDINNWRPITIGSILLRLFSRIITARLTKACPLNPRQRSFISAAGCSENLKLLQTIIRTAKNEHRPLGVVFVDIAKAFDTVSHQHIIHVLQRRRVDPHIIGLVKNMYKDISTVITTKKNTYTDKIQIQVGVKQGDPLSPLLFNLAMDPLLCKLEEHGKGFHRGQSKITAMAFADDLVLLSDSWEDMNANIKILETFCDLTGLKTQGQKCHGFYIKPTKDSYTVNNCAAWTINGTPLNMINPGESEKYLGLQFDPWVGIAKTSLPEKLDFWLERIDRAPLKPFQKLDILKTYTIPRLTYVADHSEMKAGALEALDRTIRSAVKDWLHLPSSTCDAILYTSMKDGGLGVTKLVGLIPSVQARRLHRIAQSPEETMKDFLEKAQMEKMYEKLWVQAGGKRKRMPSIWEALPEVVPSIDTATTSEWEAPNPKSKYPRPCNWRRKEFKKWTKLIAQGWGIRCFKGDKISNNWIRHYRYIPHRKLLTAIQLRASVYPTREFLARGREDNCVKSCRHCEAAEESCAHIIGMCPVVRDARIKRHNRICERLMEEAGKRDWTVFQEPHIRDVTKELYKPDLIFVKEGLALVVDVTIRFESTKTTLEEAAAEKVNKYKHLETEVRNLTNAKDVIFMGFPLGARGQWYNKNFELLDTLGLPRSRQDIIAKTLSTDALISSVDIIHMFASRGRRQHA

SEQ ID NO: 1387 - protein, 1343 aa, Zonotrichia albicollis
NKFLGKSRVAYCLKPGPPVSDRGKEFGSGLTTHPEPESESGHDPTVPNPGPSLGAGEGAQPLPLLRVSVGTQTCEEDFITSRPTKLPGIESELGPLVKFSLEVYRSDLKGDVQFEGIHFPDNWGVLEGFPEVYEQLAPQPNGGDELNHSLPGDREGDVLEKDSSEKEKEAAPEALPSVQRARSEQLPDNIVKVTVPDKNPPCPCCGVRLNSVLALIEHLKGSHGRRRVCFRCAKCGRENFNHHSTVCHYAKCKGPQIERPPVGEWICEVCGRDFTTKIGLGQHKRHMHAMVRNQERIDASQPKETSNRGAHKRCWTKEEEELLMKLEVQFENHKNINKLIAEQLTTKTAKQISDKRRMLLKKGRGTTGNLETEPGMSHQSQAKVKDNGLGGDHLPGGPVVDKGTIGKPGQHLDTDNSHQITAGKKKGGGLQARYRRRIMKRLAAGTINIFPKVFKELINDQEARPLINQTTEDCFGLLDSACQIRTALREKGKSQEERPRKQYQKWMKKRAIKRGDYLRFQRLFHLDRGKLARIILDNTESLSCDISPSEIYSVFKARWETPGHFNGLGDFEIKGKANNKAFRDFITAKEIEKNVREMSKGSAPGPDGIALGDIKKMDPGYSRTAELFNLWLTAGDIPDMVRGCRTVLIPKSTTPERLKDINNWRPITIGSILLRLFSRIITARMTKACPLNPRQRGFISAPGCSENLKLLQSIIRTAKNEHKPLGVIFVDIAKAFDTVSHQHIIHVLQQRRVDPHIVGLVNNMYKDISTYVTTKKNTHTDKIQIRVGVKQGDPLSPLLFNLAMDPLLCKLEESGKGFHRGQSSITAMAFADDLVLLSDSWENMKENIKILETFCNLTGLKTQGQKCHGFYIKPTKDSYTINNCPAWTINGTPLNMINPGESEKYLGLQIDPWTGVAKYDLSTKLKIWLESIDRAPLKPLQKLDILKTYTIPRLTYLADHSEMKAGALEALDQQIRTAVKDWLHLPSCTCDAILYVSTRDGGLGVTKLAGLIPSVQARRLHRIAQSPDETMKDFLEKAQMEKMYEKLWVQAGGKKKGMPSIWEALPMTVPPTNTGNLSEWEAPNPKSKYPKPCDWRRKELKKWTKLESQGRGVKNFRNDTISNDWIQYYRRIPHRKLLTAIQLRANVYPTREFLARGRGDNYVKFCRHCEADLETCGHIIGFCPVTKDARIKRHNRICDRLCEEAAKREWVVFKEPHLRDATTELFKPDVIFVKEDRALVVDVTVRYESAKTTLEAAAMEKVDKYKHLEAEVKELTNAKDVVFMGFPLGARGKFYKGNFNLLETLGLPKTRQLSVAKTLSTYALMSSVDIVHMFASRSRKPNV

SEQ ID NO: 1388 - protein, 1193 aa, Danio rerio
MESTAKGKSYWMARRPVEGATEGSLGRVPFVTRDPKRKPEAKRTLTHGLGLRECSVVLTRLIEGRRGRDHTPSGWNAQRGMPNDESSVEEPNGPIPSNPIPTGTQALPEPMADGEQGEHPGVVVTLPLRDLNCPLCGGSASTAVKVQRHLAFRHGTVPVRFSCESCGKTSPGCHSVLCHIPKCRGPTGEPPEKVVKCEGCSRTFGTRRACSIHEMHVHSEIRNRKRIAQDRQEKGTSTDGEGRAGVERADAGEGPSGEGIPPKRPRRARTPREPSEPPANPPILSPQPDLPPGGLRDLLREVASGWVRAARDGGTVIDSVLAAWLDGNDRLPELVDAATQRTLQGLPAGRLARRPATFVAPNRRRGRWGRRLKLLAKRRAYHDCQIRFRKDPARLAANILDGKSETSCPINEQAIHEHFRNKWANPSPFGGLGRFGTENRANNAHLLGPISKSEVQTSLRNASNASTPGPDGVGKRDISNWDPECETLTQLFNMWWFTGVIPSRLKKSRTVLLPKSSDPGAEMEIGNWRPITIGSMVLRLFTRVINTRLTEACPLHPRQRGFRRSPGCSENLEVLECLLRHSKEKRSQLAVVFVDFAQAFDTVSHEHMLSVLEQMNVDPHMVNLIREIYTNSCTSVELGRKEGPDIPVRVGVKQGDPLSPLLFNLALDPLIQSLERTGKGCEAEGHKVTALAFADDLALVAGSWEGMAHNLALVDEFCLTTGLTVQPKKCHSFMVRPCRGAFTVNDCPPWVLGGKALQLTNIENSIKYLGVKVNPWAGIEKPDLTVALDRWCKRIGKSLLKPSQKVYILNQFAIPRLFYLADHGGAGDVMLQNLDGTIRKAVKKWLHLPPSTCNGLLYARNCNGGLGICKLTRHIPSMQARRMFRLANSSDPLMKAMMRGSRVEQKFKKAWMRAGGEESALPRVFGANQYQEGEEVANDLVPRCPMPSDWRLEEFQHWMGLPIQGVGIAGFFRNRVANGWLRKPAGFKERHYIAALQLRACVYPTLEFQQRGRSKAGAACRRCSSRLESSSHILGKCPAVQGARIRRHNKICDLLKAEAETRGWEVRREWAFRTPAGELRRLDLVLILGDEALVIDVTVRYEFAPDTLQNAGKDKVSYYGPHKEAIARELGVRRVDIHGFPLGARGLWLASNSKVLELMGLSRERVKVFSRLLSRRVLLYSIDIMRTFYATLQ

SEQ ID NO: 1389 - protein, 1454 aa, Gasterosteus aculeatus
MLRGGVGTPPAGGAGAVGPGMASPGGCSVRFSPGGRRLLGHRTGGLSPSVSWRLKRLSVSLRRWSGPGLLGADGAGGGAAVASPRGTQVLGSGAGRRWLGHGSRGSSPSAARGLRRLTVRLKRLSGGLLSPKACRDAEEGSSSSPGFRNPKGLGGRGLTPLGSRRFCRLTVSLNRWRGSLVKLNASSRASGRRTPVKPACDSRAGRGSEHAEGGGVSAAPMVLRSRRKLTFSVDGDSNSGDRARSGSVSAARPGHLLVDGESASSRSGPAGDARLAGPSTRSRRKGCLPPVDFENPKKRTRLMAKMTNGNPTSHVPCPAPCSNGHEGGGRVAVIEGRLPELSGSRISGIQPALPVETSFVGQSTGRGADGDANANSSPPSPNLGGSVGMVPAVRDGTPPLGRPGEDHSRECAGGNTPLWMLEDSFRCDYCPREFGTRAGRSLHMRRAHLAEYDGAGFCWGERLSEFAATRLWSTEETKKLAVFCERGVPSPSECRAIAASLGAGKTHHQVRSKCRLVFEAIRRRELLEVAAATERLEKSARRKQPAVPPAPVHGVRGVLRGLLGKRVPREGGTTGSTSARIVRRDDCRQGAVASASLNLIRRLGRKATGRSGRRRVLGRPPRMDVRRSVRMRRMRRFLYRLARLGWAKLAMFVLDGQMGASCPVPLVEVSAVFRERWSIVRAFLGLGQFGGFGTADNAGFGKLIDPAEVRAHLQSIKNRSSPGPDGITKVALSKWDPEGIKLAHMYSTWLVSAGIPKVFKKCRTTLIPKTGDVSLHGDVGQWRPITIASLVLRLYSRILTERMTVACPSHPRQRGFIASPGCSENLMLLEGCMSLSKAGNGSLAVVFVDFAKAFDTVSHEHLLSVLVQKGLDQHMVELIKDSYENSVTKVHCQEGCSTDIAMKVGVKQGDSMSPLLFNLALDPLIQQLEREGRGFPVNGKSITAMAFADDLAIVSDSWEGMRANLDILVDFCELTGMRTQPSKCHGFLIEKSGSRSYKVNRCEPWLLNDTALHMVGPKESIKYLGVQVNPWTGIFAEDTVAKLRQWVVAISKTPLRPLDKVSLLCQFAVPRVIFVADHCMLSAKALTEMDRSIRQAVKRWLHLARCTTNGLLYSRKSSGGLGIPKLSMIVPAMQARRLLGLSRSKDETVRWMFLETTDHVAFERAWLRAGGSPDEVPELGPDLVEGSPAEGNADPVSTVRPRKRIVPCDWRQVEFDRWAGQLVQGKGIRTFEADKISNCWLYDYPPNKLKPGDFTAAVQLRANVYPTRELAGRGRTDTIDVCCRHCGEAPETCWHILALCPKVKRCRIQRHHKVCQVLVAEAERHGWEVEREKRWMLPSGECVAPDLICWLDELALIVDVTVRYEFDEESLERARIEKECKYRPLIPVIRASRVQTKKVTVYGFPLGARGKWPAKNELLLADLGLSKARTRSFAKLLSRRVLLHSLDVMRTFMR

SEQ ID NO: 1390 - protein, 1114 aa, Bombyx mori
MMASTALSLMGRCNPDGCTRGKHVTAAPMDGPRGPSSLAGTFGWGLAIPAGEPCGRVCSPATVGFFPVAKKSNKENRPEASGLPLESERTGDNPTVRGSAGADPVGQDAPGWTCQFCERTFSTNRGLGVHKRRAHPVETNTDAAPMMVKRRWHGEEIDLLARTEARLLAERGQCSGGDLFGALPGFGRTLEAIKGQRRREPYRALVQAHLARFGSQPGPSSGGCSAEPDFRRASGAEEAVEERCAEDAAAYDPSAVGQMSPDAARVLSELLEGAGRRRACRAMRPKTAGRRNDLHDDRTASAHKTSRQKRRAEYARVQELYKKCRSRAAAEVIDGACGGVGHSLEEMETYWRPILERVSDAPGPTPEALHALGRAEWHGGNRDYTQLWKPISVEEIKASRFDWRTSPGPDGIRSGQWRAVPVHLKAEMFNAWMARGEIPEILRQCRTVFVPKVERPGGPGEYRPILIASIPLRHFHSILARRLLACCPPDARQRGFICADGTLENSAVLDAVLGDSRKKLRECHVAVLDFAKAFDTVSHEALVELLRLRGMPEQFCGYIAHLYDTASTTLAVNNEMSSPVKVGRGVRQGDPLSPILFNVVMDLILASLPERVGYRLEMELVSALAYADDLVLLAGSKVGMQESISAVDCVGKQMGLRLNCRKSAVLSMIPDGHRKKHHYLTERTFNIGGKPLRQVSCVERWRYLGVDFEASGCVTLEHSISSALNNISRAPLKPQQRLEILRAHLIPRFQHGFVLGNISDDRLRMLDVQIRKAVGQWLRLPADVPKAYYHAAVQDGGLAIPSVRATIPDLIVRRFGGLDSSPWSVARAAAKSDKIRKKLRWAWKQLRRFSRVDSTTQRPSVRLFWREHLHASVDGRELRESTRTPTSTKWIRERCAQITGRDFVQFVHTHINALPSRIRGSRGRRGGGESSLTCRAGCKVRETTAHILQQCHRTHGGRILRHNKIVSFVAKAMEENKWTVELEPRLRTSVGLRKPDIIASRDGVGVIVDVQVVSGQRSLDELHREKRNKYGNHGELVELVAGRLGLPKAECVRATSCTISWRGVWSLTSYKELRSIIGLREPTLQIVPILALRGSHMNWTRFNQMTSVMGGGVG

SEQ ID NO: 1391 - protein, 1160 aa, Hydra vulgaris
MNLLIVTSSIKESDVPSSGKGGVAVNNITAGASGKDTCVIIHPGTDGIWCCTECVEIHNSGKDLKRHLAKRHPSVTISGYKCNLCPFVSERQLSVGTHLRYCRGVKEVVKREFACASCSFSSDTFSGLQVHMQRKHIAEWNDQLKEKTEFAWTDRELRELAEKELTTPSFRYNKIFYAALGTSRTYDAVRKIRYNDRYKSAIAEMRSQIADAAAAAQERDVERGLVSAHSDRGKEMLPVVETKSDIQVNNDIKKDIELTPNSRQKQTNLALARPAVIEVEEDLGRQDVKQYLASLRQDDYTSPAERSIFAYCREETNWSATKRQVLKISRTTRGLRQPKKVRPFEFPEGFKPNRNMRKWRKYRFLQECYREKRAETVSKILDGTFIDEPEEEIRPELEEVQRMYIDRLEKRTQLDTTKIVQTDEVFCLQSYGRITIGEVRDALGASKKDSASGPDGLLLQDVRRLGPLLLCNIFNMWYLHGIPVEENRCRTILLYKSGDRHLASNYRPVTIGNMLNRLYAKIWDKRIRKNVRLHVRQKAFIPVDGCFENVKTIQCVLQSYRKRKLEHNVVFIDLAKAFDTVLHDSIRKALWRKGVPSGVVKVVDSLYAGAVTSISVGKTKTRSICINSGVKQGCPLSPLLFNLILDELAERIEATGCGLDLDGHVLSSMAFADDYVLLAKDSVEMNELIRVCSTFFKEKGLSVNPGKCQSLRVLPVKEKKRSMKVLVRPHRWWRIKDQDVDIPSMTYDSLGKYLGVSIDPTGKIALPIEEWKNWMTKLKECKLKPEQKVKILKEVVCSRVNYVLRMSECGISELRSWTRFVRNWAKNIIHLPTWCSSDWIHSIKGLGIPDVSKGIVIQRMRASEKMSTSEDGIVRVVGARLVQKNRVLWEKAGFEGIELKAARRHCEVERLNNIGNITNGVALKTIAAVSSVNRYWMIEDNLKSGNKILVWKAMAGAIPTKINLSRGVADQTLKKCRRCGLTAETDGHILAGCHTSSDAYSKRHNMLCDKLAKELKLNGGPNRRVWRERTCFTSTGRRYRPDIIVKDDSKITVIDMTCPYEKSEGHLIQCESAKVTKYEPLKLDKYWTRELEGANGIVAEKVELMGLAIGAIGTIMRSTLRKLCELKSGRIVRRLQMIACNNSAQIIKGHLSRATRRNLR

SEQ ID NO: 1392 - protein, 1158 aa, Hydra vulgaris
MSNRITIGDVPSVGKGGLTVNKQTAGADGAEACVVIHPGAKGIWSSPACLRKFTIGKELRAHLAQIHKLAPSAVRYRCNKCPYEGDVQLSVGTHLRYCKGIAGVVEEKKQFACAICNFSSDTFSGLQVHKQRKHVVEWNEQLKEKTEFAWTDRELRELAVKEVTIPFSVVNTETFAVLDITTRTKDAVRKIRYTDRYKSILAEVRAQVNAVAEEAPQASDESQITLLVNTGRGAELQPAVINITDSIELVTDVNEVEMVTSNSTNEEQPINAPVEPAVIEADLGRQDAKLYLASLRQSDCTNASDRWTLAYCRGEVDWCKTKSRLFKVSRHARGLRQPQRVENWEFPEGFRPNRNLRKWRKYSFLQSCYRTKKKETVSKILDGTFKDTPEEEIRPELEEVQRVYVDRLEVRTQLDTTRTVHIDERFDLVSYGRITIREVQDAISASKKDASGGPDGLLLQDVKKASPRQLCIIFNMWYLHGIPVVENRCRTILLHKGGEKHLTSNYRPVTIGNMLNRVYAKIWDRRIRKNLQLHVRQKAFVPLDGCFENVKTIQCILQSYRRSRREHNVVFVDLAKAFDTILHDSIEKALLRKGIPRSVIKVVDSLYAGAVTSITVGKTKTRPICINSGVKQGCPLSPLLFNLVIDELAERLEATGCGLDLEGHVISSMAFADDYVLLAKDSVEMNVLMNVCNTFFEEKGLAVNPAKCQSLRVLPVKGKRSMKVLTRTHRWWKINNQDVEIPSMTYESVGKYLGVMIDPAGKIALPIEEWKLWLTRLRECKLKPDQKVKVLKEVVCARANYVLRMSGCGICELRKWSRFVRGWVKSIIHFPAWCNSEWMHSSKGLGIPDVVSGIVIQRMRAAEKMAKSTDGVVRVVGARIVQTNRVLWKRAGLAGIELDAARKFCEVKRVNKIGNQTNGGALKTIAESSVSRHWLLEKNIRPGNKILVWKAMAGVIPTKINLSRGVADQTLKKCRCCGLTAETDCHILAGCPTSRDAYSKRHNLLCDKLAKELRLNGGPSRRVWRERMCLSGNGRRYKPDIVVKDDGVITVIDMACPYEKSERHLSQCEDAKVAKYEPLRLDRSWTQELEGNNGRSANEISVVGIAVGAIGTITRKTQRILSKLKLAKVGRPLQIIACNESAQIIRRHLSGSRLRNLR

SEQ ID NO: 1393 - protein, 1102 aa, Adineta vaga
MNLPIREHAVSVHNINKFNYLCQLCSKSYDTINSVKAHYVACRRQKNASSTTAVPTNVINNNQLAINTNQVISRNPLQCVECLMKQVDFYAKDTKALVTHMRTKHAAAYEESKKVATRRVAWSPDEDQILAELEVKLKKIQKGQLLSRLVVEYNKCADKSKAPSRSKDAIRTRRQQHDYKLLLRSLQSQQPPVGSEDSDSDISSSNNNPLTTTHNVTPTPDSSNVVLLIQKIRESVDSIVKITNLKLNTNMLNAASAFINQNNNMDPLELSMRGIEEDVKAIRDKELQKPTRNVPSSTTSRKPTRNAKRLEKSKKYGYYQHLYYNNKKKLVAEILDGETSGAKPPPMNLVEDYYRNIWSRSTIDDSPVNNIKTVNSDSIFAPISRDEIKLALSNTKKDSAAGPDAVTIKEAKAIIDNLYVAYNIWLGVQGIPEQLKLNKTILIPKGNSDLSLLKNWRPITISSIILRVYNRLLAYRMNKIFKTNDKQVGFKPVNGCGINISWLHSLLKHARLNKNSIYACLVDVSKAFDSVSHQSIVRALTMNGAPSLLVKLIMDQYTNVNTVITCSGSISNKINISSGVKQGDPLSSLLFNLVIDELFDVIKDQYGYTIDNIGTTNARCFADDLTLISSSRMGMNKLLELTTKFFKERGLNVNPSKCMSIGMSKGYKGKKSKIESEPLFSITDAQIPMLGYIDKTTRYLGVNFTSIGAIDAKRIKKDLQDTLDKLEHLKLKAQCKMDLLRTYMIPRFMFQLIHTELYPKLLIKMDILIRKLAKRILHLPISTSSEFFYLPFKEGGLQLTSLKEAVGLAKIKLHKKIMSSNDPMLCYLIESQRSRIVEHFMKDLKLGDSLTLNEMNNIKECFMKEKRISFAQKIHGVGFEVFSSSPLTNQWINGEIKTMTTKTYINSIKLRTNTLETRVTTSRGLNIIKTCRRCHVADESLMHVLQCCSSTKGLRYSRHHKICAKVANKLVMNGYGVFREKSYPDPNNSGSYLRPDIIAVKNGHVIVLDVTVVYEVTGATFINAYQTKINKYNAIMVQIEQMFNCVNGELHGLVIGSRGSIHHSQLHIWHQMGFSSIELKYVAIGCMEDSLRIMSTFSKAIT

SEQ ID NO: 1394 - protein, 1276 aa, Oryzias latipes
MGTDTVYVGQDYPSGLSKRVPARLVAGPMLRERSCHAHVFRAGHMWNWRTSLPSGRWDQPALEKSRVLTRSVATATDPEITSYPGKSVSTSTQVQEEDWCSRESGWISPGLAPEEPSVVSEITASMVATMRVATEEVVLEPQPEQVVTILPEHGRNVPPGLAEQDTASPIEVSVLLPDLAENCPLCGVPSGGLRLLGKHFAVRHAGVPVTYECRKCAWRSPNSHSISCHVPKCRGRARMPSGDPGIACDLCEARFATEVGVAQHKRHVHPVEWNKVRLERRGARGGGIKATKLWSVAEVETLIRLIREHGDSGATYQLIADELGRGKTAEQVRSKKRLLRIDTASNSPDDAEVEEERLESLAVRSSSRSPPSLVATRVREAVARGESEGGEEIRAIAALIRDVDQNPCLIETSASDIISKLGRRVDGPKRPRPVVREQTQEKGWVRRLARRKREYREAQYLYSRDQARLAAQILDGAASQECALPVDQVYGAFREKWETVGQFHGLGEFRTGARADNWEFYSPILAAEVKENLMRMANGTAPGPDRISKKALLDWDPRGEQLARLYTTWLIGGVIPRVFKECRTKLLPKSSDPVELQDIGGWRPVTIGSMVTRLFSRILTMRLTRACPINPRQRGFLASSSGCAENLLIFDEIVRRSRRDGGPLAVVFVDFARAFDSISHEHILCVLEEGGLDRHVIGLIRNSYVDCVTRVGCVEGMTPPIQMKVGVKQGDPMSPLLFNLAMDPLIHKLETAGTGLKWGDLSIATLAFADDLVLVSDSEEGMGRSLGILEKFCQLTGLRVQPRKCHGFFMDKGVVNGCGTWEICGSPIHMIPPGESVRYLGVQVGPGRGVMEPDLIPTVHTWIERISEAPLKPSQRMRVLNSFALPRIIYQADLGKVTVTKLAQIDGIVRKAVKKWLHLSPSTCNGLLYSRNRDGGLGLLKLERLIPSVRTKRIYRMSRSPDIWTRRMTSHSVSKSDWEMLWVQAGGERGSAPVMGAVEAAPTDVERSPDYPDWRREENLAWSALRVQGVGADQFRGDRTSSSWIAEPASVGFAQRHWLAALALRAGVYPTREFLARGKEKSGAACRRCPARLESCSHILGQCPFVQANRIARHNKVCVLLATEAERFGWTVIREFRLEDAAGGLKIPDLVCKKADTVLIVDVTVRYEMDGETLKRAASEKVKHYLPVGQQITDKVGGRCFKVMGFPVGARGKWPASNNTVLAELGVPAGRMRTFARLVSRRTLLYSLDILRDFMREPAGRGTRVALIPAATGAAN

SEQ ID NO: 1395 - protein, 1168 aa, Limulus polyphemus
GIDGYMFGYARASGSTSVSIQSSSMTEGETNERATPRASDSSSVSIQSSCVTEGECLPPTDNCNPSVENQLPCVTEGRFERVGSLVTVRLPFRKVACDLCSKEFLTYSKFAVHQANFHNSETQACCTYCGKSDGNHHSIACHVPKCPWRRTVTFAANLSNFLCDLCNDSFKTKSGLSQHKRHKHPCSRNAERILSLGVRTPSARPRQVVWSEEETRTLREVEVVYSGQKNINVLCAGHLPGKTSKQVSDKRRDLHRIRSSNVHGTPTTQSRGDPVEQVEEYEELDWEGMHPFPDPDSKFCSYLDQLRDQKGLTEPVWQEIEIVAQEWVENLAHVQSSWNHERTTKQVPENNTPARRPFKRRLHRVERYKRFQRMYDLQRKRLAEEILDGREAVTCNLKKEEIKDHYDQVYGVSNDRVSLDDCPRPPGANNTDLLKPFTPTEVMDSLQGMKNGAPGPDKITLPFLQKRLKNGIHVSLANVFNLWQFSGRIPECMKSNRSVLIPKGKSNLRDVRNWRPITISSIVLRLYTRILARRLERAVQINPRQRGFVPQAGCRDNIFLLQSAMRRAKRKGTLALGLLDLSKAFDTVGHKHLLTSLERFAVHPHFVRIVEDMYSGCSTSFRVGSQSTRPIVLMRGVKQGDPMSPILFNIALDPLLRQLEEESRGFMFREGQAPVSSLAYADDMALLAKDHASLQSMLGTVDKFCSGNGLGLNIAKSAGLLIRGANKTFTVNDCPSWLVNGETLPMIGPEQTYRYLGASICPWTGINSGPVKPTLEKWIANITESPLKPHQRVDILCKYALPRLFYQLELGTLNFKELKELDSMVKQAVKRWCHLPACTADGLLYSRHRDGGLAVVKLESLVPCLKIKTNLRLVHSTDPVISSLAESDGLVGAIEGIAQKAGLPIPTPDQRSGTYHSNWRDMERRSWERLALHGQGVELFKGSRSANHWLPRPVGMKPHHWVKCLAMRANVYPTKRGLSRGNLSKNKDSAKCRGCTSMRETLCHLSGQCPKLKSMRIRRHNKICEHLIAEASFKGWKVLQEPTLVTDNGERRRPDLIFHRDDKAVVVDVTVRYEISKDTLREAYASKVRRYGCLTEQIKDLTGATSVVFHGFPMGARGAWFPESSDVMADLNIRSKYFEEFLCRRTILYTLDLLWKSNNEQYLERLAP

SEQ ID NO: 1396 - protein, 1687 aa, Caenorhabditis elegans
MLRRKGRHRMVMVNSVKWQPSAHAEAIGTGKSWAPQRSQASEHGWQSNAMFDPPNRILFARDSWSLNQSTHLQNQRSGSGLGIRPGQVRNNMVGGGPHRAGDPKRRVELVSIQGSEVTVRTIYPSDEIFSCYSKSCDIKTKAGYGPEDLKHLTRHIKNEHGLKARWAYQCGLCNEKSDPSVSEGHKWMEAHMVAVHQSSAEKRIKSYQKCTGARVAEQLQAAAPSLTVPGKHKSGSRDAAKDSMTPTKDDDPKTRIYQTRSVVKKSTQKTAEPTDEGSRGPKYASIFQKSVKARKSLALLCELSSPKPMNPLPTNELTLKEGNSRELAKEEAPSEGIDDIVIIDLDESEESPPRRKRFNTWCLDHESSREAWLDDTAIFWYISYLCRGSTKYSALDPCLWSMYKVKGSRYILDRLESSITYFFPICEEDHWTLLVLKDNSYYYANSLHQEPRGPVRDFINDSKRARKEFKVQVPLQRDSFNCGVHICLMTNSIMAGGKWHSEEDVRNFRKRLKKTLQEEGYELYSVNSLGIPFQAPTTEQMDYKETRCKRSYASVLTQISPPAKRPDCKPDNNIFVPTKDCAAEGNPQEKGRNESPEEINTEHIVVAGKPANNISPRCRSTSEMLFEMVKATTSSGRSSLGTMTQDEFIRTSTIAEAVPLMSIKLPPMELPRKILPPIPPRKPTQTNGGQKGKQQRVPTGKPDTLNAKVRNWFNNQLESYAMEGRSFQRLEWLTEVLTASIQKAAAGDEGIVDIICKRNPPLEVAKGEMCTQTENKRKTTNNAARIADPIQSSKGAGDVKASYWKERARTYNRIIGSKEELCKIPIDQLEDFFKKSTSRTNVQESIMKEKSSKIPALKIGNWMEKKFIGKEVAFALRKTKDTAQGADGLRYHHLQWFDPSGELLAKVYNECQRHRKIPKHWKEAETILLFKNGDQSKPENWRPISLMPVIYKLYSSLWNRRIRAVPNVLSKCQRGFQEREGCNESLAILRTAIDVAKGKRRNLAVAWLDLTNAFGSIPHELIEYALTAYGFPQMVVDVVKDMYQGASMRVKNATEKSDRIPIMSGVKQGDPISPTLFNICLETVIRRHLESANGHQCLKTRIKVLAFADDMAILTDSPDQLQRELSKLDNDCTPLNLIFKPAKCASLVIQKGVVRSASIKLKGNAIRCLDENTTYKYLGVQTGSAARISAMDLLEKVTKELECVVKSDLTPPQKLDCLKTFTLSKLTYMYGNSIPLITEIKMFANIVIRGVKVMHRIPVRGSPLEYIHLPVKDGGLGVACPKTTCMITFLVSTLKKLWSDDEYIKTLFTSLAEEVVKKESKKSTVTMDDIADYLNVEERINRSEFGYNSITRLRDVMRNLAITGDSPLYRLKMVVKNGKIALLVQATSESMERIYTEEDAKKLQRSLKDQVNKALKHRFNTTKVVKSKVVRVVQQHPASNRFVTKGGNLSLACHRFVHKARLNLLACNYNNYDKSKSKVCRRCGKDLETQWHILQNCPFGFSKKITERHDAVLHKVKTLIESGGKKNWTMKIDEELPGFSRLRPDICLKSPDEKQIILADVACPYEHGVEAMERSWQAKIDKYETGFAHLRKSGTKLTVLPIIIGSLGSWWKPTGDSLKELGIKGSVINSAIPELCATVLEHSKNTYWNHIFGEAYIPNPMRNGHAKPAGNGWKKERLQKAPVRPTN

SEQ ID NO: 1397 - protein, 1059 aa, Cryptococcus neoformans
MSLQRAKNARGDPGRCNLCSADYRDLKDHLNKQHSTHFFVPSDLRGSSLVACPRCGTPCSAGTGLSRHQSRYCGLTAPRIRRNRVGNSTNTSRCPPSNTAASPIVPSPSPERPSPPQPAEVVASLEPLSEAEEVLEVAQVDAETVDTLEGTRRAPESVPRSAEEGSTRVRELNMTAPEEEHRGEEESSHTNPTAPAGLENAVSSTLGPSPGTLPSLLPSQECANERFLYLAHLPVRSKPLPNNLVTDFMDAAERCALAYIAQPSDSTLLAFLALPKVGLTQALAPEQPLRPSTFLKQFPHIPWPEQPPARRPPSNIRPDTTKQVIKLVENGRLGAAERVLEEDASVAELDQGVIDQLITKHPKGPSCPFGNAVGPTPGKAPDIDTIQKALDSFKPDTAPGVSGWSVPLLKTAAKREPVKQFLQLLCAAIANNTAPGRSMLRTSRLIPLKKDDGSIRPIAVGELIYRLCAKALIISHFQPDFLLPFQLGVKSIGGVEPIVRLTERVLEGSAGAEFSFLASLDASNAFNRVDRAEMAAAVKTHAPTLWRTCKWAYGDSSDLVCGDKILQSSQGVRQGDPFGPLFFSITLRPTLNALSQSLGPSTQALAYLDDIYLFSNDSQVLSKTTQFLADKQHIIKLNEKKCKLISFDEIRQEGFKMLGTMVGGKEKRAEFLEGRIRKEMAKVGKLKDLPHQHALLLLRFCIQQNLRHLQRSLRSDDLVDLWERLDTMLWEEVKRMRMRQREDTAEEEALGRSLTKLPARLGGLGLLSFKDVAPLAYRSAAEASDTLLDNLGLLSSPEEPPTPIPQRTRCAELWESQQEAILHNLGDTERKRLTENASRLGRSWLSVIPYLQPLRLSNVEIASGLHDRTLVGSSIPVCRFCGSDSPLGHDELCRARNPWTQRRHNAINRVIYQHLKQIQGATVEIEPHTLSGQRRNDLRVRGSSALAFTDYDLKVYSLGDRDARSTVTPCAPNGKLADFCLDRCVNWLDKVGQVVSKNAPKVTGGVFKPIILSTGGLMSRSTADEWKDWRDAMPVGGFEKMEKRIGVELVKARARTLVL

SEQ ID NO: 1398 - protein, 1024 aa, Chondrus crispus
MSQPNISSAETPLSQLPTPVPTPPSPSNPSLSLPTVRDLLLCPIRSSHVYSSIPSSCLHSFTMLLIKTVRAASATMTPTESHRAFIHLHILPIAVLRRSFRGETGWRSRTGQHHALRQRIRRASSGRHWAALWHEALAAHQVDLDYRTRHSRRYQASATSRHRIGRAMRLAADAQYGRAMSALKAKPLPDLHAAATRDTLTALHPPPASPVQPLSPTDLPPVPEITEGQVLRAARALNPTSAAGPDHLSPRILQLLARTTISPEAGVTGLSALTNLVRRLARGDIPDRTAPLLAAATLIPLQPRPHKIRPIAVGQALRRLVTKVLLPPAIQDTRDHLLPEQLANSVASGMDAIVHDTRMLMHRHGRNPDYIMVSVDARNAFNTFSRQSLLDRLPLQTPSLARFLNLIYGRTVPDLVLPSSPRFLMKSQEGTQQGDPASMLLFSLAIQPLLRRLTRECRLDLNRWYADDGTLVGPISEVIKALRILRDDGPQSGFHVNINKCRAYWPTVMPEKLSELLRIFPLHVECGEGGVALLGAPLGTDAFVRRHLMNKVQSCHASLSLLDEIPDARTRFHLHRVTGSVCKVEHVFRLTPPHLSLPAATKFDEQQIAAYSRLNDVAVSTSMATQIGLPFRLGGHGFTPLSPFIHASYAASLIEAAPVRVKGPHNPSESFYRRMARRHIVHVLGALNPEVRTRGILGTHSPLGPFEPEALLSRPERVHHTLIQAMQGATSRLYWEHTAWDLDPLPRNHSAASVRRRARYNSLRAPGAASFLCSHPSLTSRVPSAVWSCMLRRHLDTPVYCDSIRPLICSHCCKPMDARGDHAAICRHGFGVVHRHNTVRNLLARHAFRAAGLCCDLEVPSLLPNTANRPADILVQPAPPPSGALPDRPTAYDVTVRSPYCRSTMSLAAKGLAGAAEAADLDKLRVHSRTVRDAFHLQPDSPLPLLDWHFVPLAFDTLGATSSRTMAVLEYLAHRIANRTYSSYGTAKIRLLQRISFAVWSSLASATLSRMPYHGAALSSPAQV

SEQ ID NO: 1399 - protein, 1353 aa, Chondrus crispus
  MOD_RES (3)..(4): Any amino acid
  MOD_RES (6)..(6): Any amino acid
  MOD_RES (31)..(34): Any amino acid
  MOD_RES (46)..(46): Any amino acid
  MOD_RES (52)..(52): Any amino acid
  MOD_RES (59)..(59): Any amino acid
  MOD_RES (79)..(79): Any amino acid
  MOD_RES (85)..(85): Any amino acid
  MOD_RES (92)..(92): Any amino acid
  MOD_RES (96)..(96): Any amino acid
  MOD_RES (98)..(98): Any amino acid
  MOD_RES (100)..(100): Any amino acid
  MOD_RES (103)..(103): Any amino acid
  MOD_RES (122)..(122): Any amino acid
  MOD_RES (140)..(140): Any amino acid
  MOD_RES (163)..(163): Any amino acid
  MOD_RES (170)..(170): Any amino acid
  MOD_RES (188)..(188): Any amino acid
  MOD_RES (193)..(193): Any amino acid
  MOD_RES (199)..(199): Any amino acid
  MOD_RES (207)..(207): Any amino acid
  MOD_RES (209)..(209): Any amino acid
  MOD_RES (220)..(220): Any amino acid
  MOD_RES (257)..(257): Any amino acid
  MOD_RES (274)..(274): Any amino acid
  MOD_RES (276)..(276): Any amino acid
  MOD_RES (292)..(292): Any amino acid
  MOD_RES (298)..(298): Any amino acid
  MOD_RES (303)..(303): Any amino acid
  MOD_RES (306)..(307): Any amino acid
  MOD_RES (309)..(309): Any amino acid
  MOD_RES (333)..(333): Any amino acid
  MOD_RES (344)..(344): Any amino acid
  MOD_RES (353)..(353): Any amino acid
  MOD_RES (368)..(368): Any amino acid
  MOD_RES (382)..(383): Any amino acid
  MOD_RES (391)..(391): Any amino acid
  MOD_RES (476)..(476): Any amino acid
  MOD_RES (480)..(480): Any amino acid
  MOD_RES (573)..(573): Any amino acid
  MOD_RES (591)..(591): Any amino acid
  MOD_RES (620)..(620): Any amino acid
  MOD_RES (669)..(669): Any amino acid
  MOD_RES (678)..(678): Any amino acid
  MOD_RES (707)..(707): Any amino acid
  MOD_RES (709)..(709): Any amino acid
  MOD_RES (728)..(728): Any amino acid
  MOD_RES (759)..(759): Any amino acid
  MOD_RES (780)..(780): Any amino acid
  MOD_RES (791)..(791): Any amino acid
  MOD_RES (799)..(799): Any amino acid
  MOD_RES (845)..(845): Any amino acid
  MOD_RES (857)..(857): Any amino acid
  MOD_RES (860)..(860): Any amino acid
  MOD_RES (878)..(878): Any amino acid
  MOD_RES (880)..(880): Any amino acid
  MOD_RES (882)..(882): Any amino acid
  MOD_RES (896)..(896): Any amino acid
  MOD_RES (939)..(939): Any amino acid
  MOD_RES (959)..(959): Any amino acid
  MOD_RES (1030)..(1030): Any amino acid
  MOD_RES (1038)..(1038): Any amino acid
  MOD_RES (1066)..(1066): Any amino acid
  MOD_RES (1139)..(1139): Any amino acid
  MOD_RES (1153)..(1153): Any amino acid
  MOD_RES (1155)..(1155): Any amino acid
  MOD_RES (1217)..(1217): Any amino acid
  MOD_RES (1253)..(1253): Any amino acid
  MOD_RES (1262)..(1262): Any amino acid
  MOD_RES (1271)..(1271): Any amino acid
MAXXPXISPPGAPPAPLRYRMLQCPPPLPKXXXXPVPHPMSSPIRXRLPHRXMRGPPSXTPPRDMHRPHGTPGPHSHRXCGRPPXHCTHASXQPRXAXHXLQXPKLRSPPPHPHVSPLILCXGPLPTPMTQPRMKRALSXSAKAPPTKRPSASQGPAASSHDXPRTPPPXPPRPPPYRFPPPTLDQHXFALSXAYPHPXPRRPPSPXRXLRHSFPPRFGXQTFSSIPGPRLHSTVLLLIRLVRAATAANTPETTTLXSCTFTCSRLPFFERPSXAXLAGGPRAVNFMLSACXYGERVXDESGXSYXXKXHCITSHPPRPRRYSRQHSRNHHTXFLHLHLLPTAXLREAFRGEXGWRSSRGQLHALRLXIRRACTGREWGLLXXEALDAHSXRTEWQHTHARRPSPPVSPSARAARAMRLASQAQYGRAMRTFTNPPLADLNDPATMERLQALHPTPTVPVVPLPPSAQPRPPEVTXEAVXRAVRRLNPNSAAGPDRMSPKLLHLLAHTPISPEAGVTGLSALTNLVSRLARGSLPPCTIPLASAATLLPLQPRPGKIRPIAIGQALRRLVTKXLLPAAIDDCRDHLAPEQXANGIPNGIDAIVHDARMLVRRHGNDPHYXMVSIDASNAFNNFSRQQVLDQLPTRAPSLSRYLDMVYARAPSPLVLPSXPPTILHSRXGSQQGDPASMLLFSLALQPLTRLISRECXLXMNRWYADDGTIIGRIDEVXKALDIITKEGPRFQFFLNPSKTRVFWPSRQXDLLSPLMTVGPLRVIDEGGVXLLGAPIGSPSXMAQYIREXLNTCKTALAHLDHIPEARMRFHLHRVSASACRLQHLFRLVPPDFAXPFAQQFDRDQLXAYXRFNSVTMSPRIVPKYGCXFXTXATASPHWHLPYTPXTLLASSIPLQHGYKVPTFPPSLSISVLHEARCGSFFEIYLHSXNPHTSRCDYVAKNRAQIRLXFSHGGHGLTSLASTIHASYAASLIDTAPARLQGPHFPAVSQYQRFARGPLRVVLRNLPSFVQPAHFSMTEXDLGCLEPXALLARPERIHTFLLQAQYSAAASSYWQXPLWESFPNPGDHSAASLRKRVRYNSLLAPGATSFLTAHPAATSRVHNATWSTMLRRHLDAPVTNDSISPLRCXHCSKPMDARGDHAXIXSHGFGTLHRHNTVRNVLARQLFRVAGLAYSLEVPFLIPNTAARPADILVQPPPPAPGLPPDXPTAYDVTICSPFRRGMLYHAARHRGGAADAASVRKXKALERTIRXALLIEDDNXPPPLDWHFQPLSFDALGAPSQSTVHVIEDHAKLMALRNSCTIATAKSRIQQRLSFAIWSSAAAAILSRLPTHAADISYPIEV

SEQ ID NO: 1400 - protein, 1473 aa, Acanthamoeba castellanii
  MOD_RES (144)..(144): Any amino acid
  MOD_RES (216)..(216): Any amino acid
MATTTISRSPSSSSSSSSARSRASASTSASVASIPRLFRDGRFHCPLAHCQTRTSTWQDLSAHLTRMHDGDVPRDVAAACGIVQCLHEGCRKWFRGAAGLASHRGKARHAPPPAPRAALAVAAVPRADSRGRTPAPTPSVAPPXAGPPPRAAPRAAPSPLPCPPALPHPPPSASPPTSSVTSPCSPPTTPPSQPSPDLFSGFANAPTTPSPPSTPXSSPAGSPIPAARRFVLPVATPYPAPAPRANRPKLSPVARPFVPKARAGAIPEASSPVTPQDRAVSRREDAAAAPSSAPGLGLADEHEDDDTYGGDTIALTAPHAPRETRAPFEFEACFLEEEAPATAGDLPPYARAFLACPSARLQEIPRRLKSAWQAAAKTIAEAALDCHTAGDTQGYNAHLRLFIELPARGLAVPTNCRGAARTKLQRERLLDIAAGRIPAIPDPPCDAPGADDALRGFPVSGTTAGDVSNDDDSGGVHDRPAATASARQAKRLVEQGLSSRALRALERGEPAVASADTLGRLEALHPPNPTDRGLWPGAPKAAIPRVTAKHLAQVAKELPRGSAPGPSGWTFELVQAAIDRQPTGTVAAFLIDMAQRALRGTLHWRGLLTASRLVALKKPDGGVRPIAVGEALYRVIGRLVLKADRVMSSADATQYVGRHQYGVAYPGGVEAPVHAVRELHDSGQLRAVVSLDWRNAFNSLDRVHTALLIADRAPALARLYEWSYREDSVLVLPRAFEKAGLPASLLSQAGVRQGDVLGPLFFAIGAAPVLDEIDAIPYVTPRAYLDDIFVTIPHGVTDAATKAAVAATFATAEREGAAAGLRLNRCKSAVWAADAEALLPPHAAGAREDVESCAPVREGLKILGAPVGSPAFVAKSLDGIIKRAIGTLDLVADAELPLQHKLVLLRQCVAQIPTFWARAVPDAGPALAVWDTALLRRTGALVGLDVRDGSLQADIARLPVRLGGLGLRSMKDTAPRAFVASILFAAALANTRRSELTCSASTARRLRAALPELARTDACNDEAAWRRSIARGVFPDVDKLGTTQLQRVLQGMADSKSAHRTRRQVPFLFAAVFEDAATPGSGAWLAAIPSDPTLVLPDAELAEAVRIKLLTTTANAAGVCPACHKTGIDPSHAYTCVSLSHLRTARHDVVVRRVELACKTEKPVREHVLAIPPVAPTDNNNNGDEDGSPVTTADDNADGHAVATKRRPETRASARAAAAAATAAAAAAIINDNSLLSDDDDDDDHDDNCHGEERGEGERNVTCPGHYTATPFAADDTLDNSDEDNEDNAHEDDDEDGKDDNDDDVYNNCNSSSSDGDEGGDDLDYEYSDQSVTRSVDAATGESPNPERPTTPTRALLRADLWLPATSTAVDVMVAAACRRSRAKAFDRAVSRKAAKYGPAVADGSIAKVVPFVVSPFGVLSRPAKAFLKRAMGDTTAAKQAKARLRLAVAAVRGTARLSYAWGACAALIVGGN

SEQ ID NO: 1401 - protein, 1220 aa, Fragilariopsis cylindrus
MAPLPWNAATSSPPSPVPLTNDKKKDSTLPTATSKNLSKNNNNKNNNTNRINNIKNNDNTNDGSNKINLKLPPAAVKITNPYKNKKKNKKKNNAGKSNPKTNQNPNSSPLSDNDDDDTDSSNITINRRLKFGTDDLAPPNPPSNTNTIGTATAATAATATTTATAATATTATNTTTTTTTTNNTTGDNLASNINNNNNNNNSGSNNSNTNNINNTDGNGSNNRPPPRVYTVDPRSDLPGAEISAANKMLDEVYGDHVHDNPGSHLSGLISSSQDQLWQGYFRRLIPHNQSLYDCPKGKLGKDITNEYSNLFEAIMNGKCNMEKLLVFPVVVLQRRHGVTKNADVKRRLLSRLTAWKEGKFKYLVEDTHRDLIAKQSKARGDTTPAHRAKVYSSKLMRGHLQSAVNYITDREGGGILYPYDVDEKSGHTVSRVLQDKHPSMRDPGPTAMPAYESVPELPTLEITADTVEIVAGKLSGGAGLSGVDSIQLKHLLLHHGQASQRLRNVCAKFGRWLANEHPPWASYRAMLANRLIALDKMPGIRPVGIGDTWRRFFAKLVLAVSMSYATDCCGSDQLCAGLRAGVDGAIHGLSAMWREMESEENTGFVLIDADNAFNEVSRINMLWTIRHEWPAGARFAFNCYRHHSLLVVRNPGGKPFTFFSKEGVTQGDPFAMIAYGVALLPLIRKLKELNVLLVQSWYADDASAAGKFDEILRLFQDLLRMGPDFGYFPNASKSILITHPDNVVAAHHFFNETHGLGFKISTGSRFLGGFIGDTTSRDEYVSTKIADWIHGTKELAAVARLKYPHAAYTGITKCLQHKWSFTQRVIPGIDDLFQPLEDELTNNLLPALFGDPPSTMDDKLRLLTALPVKHAGLALPNPVTSSATNYKNSTLMSSHLLLAVQGKINFSLQDHRDTCQSSLSASRELRQTENDSSLTNLLAALPPAAAGQPSTTRAIKRAGETGLWLTTIPNHINGNILGCDEFIDAIRLRYQKVPHNLPAKCDGCGSAFDVGHALQCKSGGLIIRRHDELNLELASLAKMALRESAIRAEPEINPSASIMDSPTTITAIDTNGDRGDLLIKGFWDNGMDAIIDVRITDTDAKSYRTRDPKKVLQSQEKEKKKKYLDQCLLQRRAFTPFVVSVDGLIGYEASNVLKQLSKRLADKWNKPYSVTCGIVRSRISIACARASNQCLRGSRIPFKTMSRQIQWEDGAGAGLYRIVR

SEQ ID NO: 1402 - protein, 1027 aa, Hydra vulgaris
MNMVSICKRCDRSFTTLKGLNIHKGQCKIFVSNTNKQINNVVNNELTTPNKNKVEINTILNCDEISVEHYSTNTPYLPKINICESIIDPNDYLWGHMPFSFLLNHVNTIYDEIVFYHKNLFKVPSGKGGKMFIEELTFWLKQFNNRTKLNGIAMKCFMIVPSLMLQKPSIRSKAKEHAECLVRRITLWRNGNFSELMREIRYIQSKINTSKKKRTFEDISRIFAKLMMEGKVAAALKVLDRESSGILQCSESVLKELKSKHPDETPVQDNCLLYGPLQNTPECLFDSIDEISIFNSALQTKGSAGPSGMDADLYRRVLCSKCFGPSCKTLREEIATFTKNIATKSYQPDIVQPYIACRLIPLDKNPGIRPIGIGEVLRRIVGKTISHHCQKEIKEAAGPLQTCAGHGAGAEAAIHAMQKIFHQEDTDGVLLIDARNAFNCLNRSVALHNIQITCPILAMYLVNTYRKPAKLFIYGGETIFSKEGTTQGDPLAMPWYSLSTVTIINTLKLVIPDVKQVWLADDATAAGKLQSLKKWYKCLEDVGGLYGYYVNQSKCWLIVKSDNQAEEAKLIFGNSINITTQGKRHLGAALGSEAYKKVYCEDLVSKWSKELNNLCEIATTQPQAAYSAFIKGYRSKFTYFLRTIEAFENFVTPVEKILSEKLLPVLFGTDCSIIKENRDLLALNPSEGGLGICNLITEAKEQHTASKKITNLHIKSILDQSDVMKEKDDFGKTFSEIKTKTNMDKSKKKKEEVKKIHAGLPENLKLLVEQACDKGASSWLNTLPIKEQHLDLNKEEFKDALRLRYNVPLANLPSYCACGEKFDELHAMSCKKGGFVCNRHDNIRDLLTVCLNKVCTDVQAEPHLIPLTNEKFNFKTANTNDEARLDIKAKGFWRKGETAFFDVRVTHVNSKSSKKQPTKHIFRRHEDAKKREYLERVLEVEHGTFTPLIFGTNGGFGDECKRFTALLAQKLSLKMGERYGAVINWLRTRLSMEITRASLLCLRGSRTPFRHYNTDDVGLENVQCGLI

SEQ ID NO: 1403 - protein, 1068 aa, Lactuca sativa
  MOD_RES (33)..(33): Any amino acid
  MOD_RES (100)..(100): Any amino acid
  MOD_RES (350)..(350): Any amino acid
MASSSTSSSDICLCPFRSFHCCPNGEVGSKGIXRMISHIKRHHLLTEDRKCVLREALSSDVGLFMAVEETLKAFGQWMCGKCMTLHALSRYCHHPDGRVXFVTGADGSSRYIVGILKPSTKESVTNALGGLVFDVGLLDRVFKEPITTVKSIPHSCRLAFSQALKTALYKVIAQPGSVDAWICLLLLPRCTLQVFRPKNRQECRSGNRKSLQQSSILKSLDTWGKEDGIRKLVQNMLDNPEVGAMGQGGGILQKESTSSNTNIRQCLRKVADGHFTAAVKVLCSSGVAPYNGDTIKALEDKHPFRPPPSMPSPIISEPPLVADFDCVFGCIKSFPKGTSCGRDGLRAQHXLDALCGEGSAIATDLIRAITSVVNLWLAGRCPTILAEFVASAPLTPLIKPDNGIRPIAVGTIWRRLVSKVAMKGVGKEMAKYLNDFQFGVGVSGGAEVVLHSANRVLSEHHADGSLAMLTVDFSNAFNLVDRSALLHEVKRMCPSISLWVNFLYGQAARLYIGDQHIWSATGVQQGDPLGPLLFALVLHPLVHKIRDNCKLLLHAWYLDDGTVIGDSEEVARVLNIIRVNGPGLGLELNIKKTEIFWPSCDGRKLRADLFPTDIGRPSLGVKLLGGAVSRDAGFISGLAMKRAVNAVDLMGLLPQLCDPQSELLLLRSCMGIAKLFFGLRTCQPVHIEEAALFFDKGLRRSIEDMVVCGGPFFGDIQWRLASLPIRFGGLGLYSAYEVSSYAFVASRAQSWALQDHILRDSGICGMDSDYLCAMTRLRDTIPGFDCSGFTNKDTPPKSQKALACALFSKIVKDMEVDFDMTVRQKAVFECLRAPHAQDFLLTIPIDGLGQHMSPVEYRTILRYRLMIPLFPIDEICPVCRKACLDTFGEHAVHCRELPGFKYRHDVVRDVLFDACRRAGISAKKEAPVNFLTDPQDGRSTLRPADILVFGWVGGKHACVDLTGVSPLVGLRSGGFTAGHAALKAAACKVAKHENACIENQHVFVPFAFDTFGFLAPEAVELLNRVQRVMHSNVISPRSTDVVFKRISFAIQKGLAAQLVARLPSIDMY

SEQ ID NO: 1404 - protein, 1461 aa, Monosiga brevicollis
MATESGGEDSWTQVRGAKRPSAESPPSNTTTSPSQTHRSAKHTKHGSARHDRNHVFPDPMTTPLRPHARHSVPTARASSHVPSTSPAAGATESSARAVVPAAEPVTRTSNGGGEQHPIIGNTSNASPRTPRTPSSPRSFAQVAAAMPAAATATSSAPMTEDLSASVPSEPNGSGEQQPSPESTGQTHHSIPNTPSDFLTMSSDESDSPPRSTALRAPTPIAPPAHDGDGDTNGSATPEPLVQSPTPAQMVLPYPSGTQQTHSDPSPPSASPPATTILPAAISHPVEHSEHANSAPLGEVSESETHNTAGEHSESEQDVLLSDPAPPIAANVLDAQRKVLLKTSGHRQLLACPFGLCKCKGPRLDRKAWVNHVLREHPYDEQATDLVKQVMEAKLVAQCNKCHLFFEAAGISQHRSRCGANLKRATEALFHAAGHDLLEIMRGAWPQQCVGSRISVCELLKLARHPLMQRSRYPSNATETKLMAATLSQLYWSAVHSDYTAEEREMCWALILALPSMLLSAPSTALSTIDLRNMFHDRLRWLVTGQLGRVVDAMRKAVARKQSRRGQLNAGAGAHPNDAVDQSLRSLVRDPDLADEAWANHVTNRLNRGQIAKAFDADKARAVIGNSEVQAVRDLLVPPGLTPYIASTPASTSTLAPATAVSSPTVSFTKGELPKALAATKGVTDPYGWSGELLASIYRIKEHFSQVLGPRQGSTSDPTAPSDGDAPQGPTTATGGPQVALNKIFHHIANNTVPESIRHALCSINYTILEKANGKFRPVGTDSIFNKVVNRALLEQQQPHIAHLLQASPELAVGVKDGISAAVGMAFGELQACESTPGWTMLSLDFKSAFNYTDRARLHEIVADKVPGLLRAFERHYARPTTHCIVDKFFKVIDIDVGQGIVQGNELSPFFFALYSCEVLGLLDATTDYRCKVIKYLDDIVLMGPAEDVAADVEIVKARAESAGLHLQPSKSRFYMPRHHSASITAIKSVLPDAVRETANTGMTVLGTPIGRREWMKKQLNDKAKHIAGKLNDMLTTGVSLQALLTAMQYVPSLINHLYTLPPSLTSGLSELLNRACKDTFVKAFFAKVNLSAPAGAEGHDVTLEQLLEARLFTRANTGGFGLHDLVERGPVAYVCNMAKLATRYPRVYDRLLEDASRAADFEAHVQRAGFQMATVKDAATQRPAEIIALRSKAALDDLMAKCALDLQQAYLASREWGVSTVLTMRGRDKLRRLSDTTFAIAVVSMMGFGLHELINVKPTDKCPLCSSKTPQPRLTREHLLTCRPIKRHNALRDEMGRLLRYATLSHVWVEKSGYNANGQSCRIDLHCRNPFPGGALGPALPDLGIDVTVRTAQPPTTSQACIKVGAALRRAEKEKRDYYTGFNHGKTLIVPAAMTTTGGFASSFVDLLGQLARCAEARGVYQPGLDEAFVPRWKGRFAALVHQMNADHIQRHFGGVCLRSS

SEQ ID NO: 1405 - protein, 1095 aa, Hydra vulgaris
  MOD_RES (276)..(276): Any amino acid
MSSCKVTIPHVCPYCKVELKTICGINRHILKCKKNPLQIPSLQKTNTSLTLEPNTKVIPSITKQNDIIIASTSSNNLAFNQKKDYTLTPTYSRKTTPVSILSSMKMTPISITSHIVRRKLPELPSQTTNHLFNENFINVPFLPEIMNHLPVPNNNVMWGVYSYQQFKLFVDSTYDEIVNYRRNIFNIPSGKAGKEFIEELTFWLRKFNSTSSLNSIALKVTMILPNLLLQKPSAKSKSKEHTLCLTRRIDLWKKGDTSLLLKEVRNIQKKFVNSKXKRSMDDISRIFAKLIMEGKITAALKFLEKEASSGILPLSDNTLKDLKSKHPEPSRVEDYSLLFGPIDLIPKCFFDCIDEQLVMKAAFATKGSAGPSGMDADIYRRILCSKNFIKEGKELRKEIAKMTQNLLTETYEPTFLEAFTACRLIPLDKNPGIRPIGVGEVLRRIIGKVISWSFNSEIKEAAGPLQTCAGHGAGAEAAVHAMKEIFDNVQTDAILLIDAKNAFNCMNRQVALHNIQIICPLISIYLINTYRNPSRLFVAGGKEISSQEGTTQGDPLAMPWYSCNTTIIIEHLLVNYPQVKQVWLADDAAASGSIANLHSWYQHLIDEGCKHGYYVNQSKCWLIVKSPSLAENAGIVFGKSVNITTEGQRHLGSVIGSQNFKNKYCTEKVAKWLTELKQLCKVAETQPQAAFIAFTKGFRSKFTYFLRTIPKFEQYLAPVDEILSHLLLPTLFGKDTPFEDHIRKLFTLTPRDGGLGIPILVEEAPHQFLSSVKLTKNLVQQIIDQDKILKTKNSSGNVLEDLEKILTTDRLKHRKEKIIAVDSMQPDSMLRNIQQTRSECASTWLNALPLENQGFVLNKEEFRDALCLRYNFDLKNIPRICECGEPFNVTHALSCKKGGFISSRHDNIRNLFTTLLKRVCINVQSEPHLIPLDNENFYFHTANKSNQARLDIKANGFWRNGQTAFFDVRVTHVNSMSNKNLDIAAIFRKHEKEKKREYGERVREVEHGSLTPLVFGTNGGMGKECHRFVRRLAEKLAEKQNEKYSVVMTWLRTKLSFEILRSTILCLRGSRTPWTKKNDFEIGVDFKMDALEARI

SEQ ID NO: 1406 - protein, 1070 aa, Magnaporthe oryzae
MVCPTCNGVYADYNDHIRKKHPDERYTALQLQPLGLTPCPICKTACKNDLGVKTHLSKIHKISGASKISTQPRIRTENTDNTNSVPTSSFNPVLPEIQTLTPGLNNSRWADNPRKRRADTPSPTRGRNTRPRRFSYTDIDLTNDEPADNPRANNPRVNNPRVNNEPPSSPNSLPSISEFHTPGTLPLTNSNISLKDQHDKITGPILQKPLIQKLIEYSKIPIPEHHLHARQAKIFADAANRIAKNFIQSPTEKTLFNLLILPRIFGIGLINGKVTKIMQNFPSQIPPIPKIDFPSEKTDSDPVLNAKKLLEKGYIGRAAKAIIDPTPVAPETPESLNILREKHPIGQNNPFNTKSQPISGRQITEKAILLAISSIGREKAPGLSGWTRSLLDAAIKIPTQNDVIPALRLLTDMIRQGTAPGRELLCASRLIGLSKPDGGVRPIAVGDLLYKIAFKAILNTLWSPNCLLPYQLGVNSIGGVEPAIFTLEEAIMGPNINGIKSITSLDLKNAFNSVSRAAIASSVAKYAPTFYRSTCWAYNQPSILITENGSVLASAQGIRQGDPLGPLLFSLAFRPTLETIQKSLPYTYIAAYLDDVYILSKTPVKDKIAKIIEKSPFTLNSAKTTETDIDTLKTNGLKTLGSFIGPTELRKEFLQNKIQNFESSINALKKLPKQYGLLILRKSTQLLLRHLLRTLNSQDLWELWEKTDKLIADFVINLTVTKRKKRPITDFVTPLITLPIKDGGFGLLRHNGIAQDIYFAAKDLTTEIRHKIQRISNDFPQNQSPTATEILHLLHNGVLADCKNGLTNAQLNALTENASYLGRKWLNILPIQKSNRLTDWEMAEAVRLRLLAPVKPLTHPCNHCGNRTNINHEDVCKGAVRKYTARHDQINRSFVNSLKSRPEIDVEIEPDLNNENNVNNANTTTENPTPSPNGQNDTGCLFTTPIRSGTRNGQNGLRADFAVINGVSKYYYDVQIVAINKDSGNTNPLNTLADAANNKRRKYQFLDPFFHPIIISAGGLMEKDTAQAYKQIQKLIGPVAAHWLDTSISLILLRSRTTAAISIAKNRPRA

SEQ ID NO: 1407 - protein, 1101 aa, Branchiostoma floridae
MNAVCVCGKVCKNQRGLRIHQTKMACLRRVQAEHRSGAVATTVEPVLSASAPGQTEEDQGPEAPHSARNLRATPAPPQGRKSDHHRVKWPAANSKEWSQFDEDVDMILESVSRGSTDQKLQSMCTVIMSMGAERFGTIGQRKPTDTMKPNRREVKIRQLRQELKSLRRSFKASTSGEERAALAELTHHLREKLRTLRRAEWHKKKGKERARKRSAFITNPFGFTKRLLGQKRSGNLTCPVEEINLHLSNTFSDASRDVDLGPCPLLVTSPEPEVHFDISEPTLKEVRETVKAARSSSAPGPSGVVYKVYKHCPRLVVRLWRILKVVWRRGKVAADWRQAEGVWIPKEEESSKVDQFRLISLLSVEGKIFFKIVAQRLIKYLLDNQYIDTSVQKGGVPGVPGCLEHTGVVTQLIREAKENRGDLAVLWLDLANAYGSIPHKLVETALTRHHVPESIQNLILDYYSNFWLRAGSSTATSAWQRLEKGIITGCTISVPLFALAMNMIVKGAEAGCRGPVSRSGTRQPPIRAFMDDLTVMTATVPVCRWLLQGLERLITWARMSFKPAKSRSLVLKKGKVAERFRFTLGGTQIPTVSEKPVKSLGKVFNSSLKDTASVQQTRSDLTTWLEGIDKTGLPGSFKAWMFQHGVLPRVLWPLLVYEVPMTMVEQLERTISRFLRKWLGLPRSLSNIALYGRSTKLQLPLSGLTEEFKVTRAREVLMYRDSSDSKVSSAGIHVRTGRKWKAQEAVDQAEARLRHSVLVGSVAVGRAGLGSCPKPRYDKVSGKEKRLLIQDEIRAGEEEDRRCRMVGMRKQGAWTRWEHADSRKVTWPELCRAEPSRIKFLISSVYDVLPSPANLHVWGLAETPSCQLCQRRGTLEHILSCCPKALGEGRYRWRHDQVLRVLADTVSNAIQSSRSQQPPKKSIVFVRAGEKTRQQPTSAGGLLSTARDWQLLVDLGRQLKFPEHIVATSLRPDMVLVSESTRQVVLLELTVPWEERISEANERKRAKYAELVVQSQSNGWRARCVPVEVGCRGFAGQSLAYVLKLLGVRGFRLRKSIRDILEAAEKASRWLWFRRGEPWKPHGHRSGNDQPRLGRPGEGVW

SEQ ID NO: 1408 - protein, 1087 aa, Danio rerio
MTHANEQTTNKIYVTCICGKLCKNHWGLKIHQARMKCLEQESKVQRTGPEPGETQEEPGPEATHRAKSLHVPEPQTPSEVVQQRIKWPPASKGSEWLQFDEDVSNIIQAIAKGDADSRLKTMTTIIFSYALERFGCIEKGKTKPTTPYTMNRRATQIHHLRQELRSLKKLYKKATDEEKQPLAELKNILRKKLMILRRAEWHRRRGRERARKRAAFITNPFGFTKQLLGDKRSGRLECSIEEVNRFIEETVSDPLREQELEPNKALISPTPPAREFSLRGPSLKEVKEIIKASRSASTPGPSGIPYLVYKRCPGLLLHLWKILKVIWQRGRVAEQWRCAEGVWIPKEENSKNINQFRIISLLSVEGKVFFSIVSRRLTEFLLENNYIDPSVQKGGIPGAPGCLEHTGVVTQLIREAHENRGDLVVLWLDLANAYGSIPHKLVELALHRHHVPSKIKDLILDYYNNFKMRVTSGSETSSWHRIGKGIITGCTISVILFALAMNMVVKSAEVECRGPLTKSGVRQPPIRAYMDDLTITTTTVPGSRWILQGLERLIAWARMSFKPSKSRSMVLKKGKVVDKFHFSISGSVIPTITEQPVKSLGKLFDSSLKDSAAIQKSKKELGAWLAKVDKSGLPGRFKAWIYQHSILPRVLWPLLIYAVPMSTVESLERKISGFLRKWLGLPRSLTSAALYGTSNTLQLPFSGLTEEFMVVRTREALQYRDSRDGKVSSACIEVRTGRKWNAGKAVEVAESRLQQKALVGTVATGRAGLGYFPKTLVSQVKGKERHHLLQGEVRASVEEERVSRVVGLRQQGAWTRWNTLQRRITWANILQADFQRVRFLVQAVYDVLPSPSNLHVWGKNETPSCLLCSGRGSLEHLLSSCPKALADGRYRWRHDQVLKAIAASLASAINTSKNHRAPRKAVHFIKAGEKPRALPQLTTGLLHKASDWQLEVDLGKQLRFPHHIAATRLRPDIIAISEASRQLIILELTVPWEERIEEANERKRAKYQELVEECRERGWRTYYEPIEIGCRGFAGRSLCKVLSRLGITGVAKKRAIRSASEAAEKATRWLWIKRADPWTAVGTQVGT

SEQ ID NO: 1409 - protein, 1001 aa, Branchiostoma floridae
MALPAVRSGPASTWTLLITLVIVAAKGTDGFMSFKLPLLSTDTWSGYNNDVKTLLGPLHHELATNEMSPKLAGEGFSDIMCDFMASKPEFSHTTEESHSEGYISHEPQSLAQVKRLKNKLRKKAFRADATPEDRKAFRDAIKTYSFMKRQQKRKETTKSAAHQEKEYHKNFWKFAGKCAKGQLDIPPVKPAFSVYYANEYYKNKYSHPTRVDFNKLLWFPHLPVEEQLPANSFDMSPVRPKDIKAVLSKRCATSAPGPDGIMYGHLKHLPACHLFLSTLFSKLLESGDPPTSWSSGNVSLIHKDGSPEAAENFRMICLTSCVSKIFHQILSERWAKYMTCNDLIDPETQKAFLTGINGCVEHVQVMREILAHAKKNRRTVHITWFDLADAFGSVEHELIYYQMERNGFPPIITTYIKNLYSRLKGKVKGPGWESDPFPFGRGVFQGDNLSPIIFLTVFQPILQHLKGVEQQHGYNLNDKHYVTLPFADDFCLITTNKRQHQKLITQISSNTKSMNLKLKPRKCKSMSIVSGKPSDISFTIDGDPVKTTKDAPEKFLGGYITFLSKTKETYDILAKTIETTVENINKSAIRNEYKLRVYMEYAFPSWRYMLMVHDLTDTQLQKLDSIHTKAIKTWLRMQPSATNAILYNTRGLNFKSISDLYLEAHALAYSRSVLKADEKVKHALQAKLDRESQWTRKMQKWGIGKCHTIHQQAIHVAKDSEWTSVRKHVKQQVTDMRHDVWTKHQENLLQQGQMLQLLEEEKCDLTWRSAMYNLPRGILSFAVRASIDALPTLCNLTTWGKRNTDKCKLCGNRETLHHVLNHCGVALQQGRYTFRHNSVLKHITDTIIESIDTSRINATIYADIQGYTTNGGTIPVHTIPTTQKPDLIIYLPEQKTLHIHELTVPFEKNIKTSHDRKVNKYSTLAADLETAGISATLTCFEVGSRGLVTPENKTRLRTLFKIVKAKPPKTLFTDISRIAMLSSYAIWNSRHEPYWESETLL

SEQ ID NO: 1410 - protein, 1074 aa, Danio rerio
MTTHRAEVTTSGKTQEEPGPEATHSAQSLLVSPTPAAGRSPATQSCPQVTAAHNSPQSPQSQQVAVTRSDCVPLAQPRIQWPQSSKKAEWLQFDKDVNQILEVTGKGGVDQRLSTMTTLIVNIAAERFGTVTPKPTPSTYTPSHRVKEIKRLRKELKLLKRQYKAAGEVERAGLEDLRGILRKQLVNLCRAEYHRKRRRERARKRAAFLANPFKLTKQLLGQKRTGKLTCSKEAINNHLKATYSDPNREQPLGPCGALLTPPEPTSEFNMKEPCRSEVEEVVRRARSSSAPGPSGVPYKVYKNCPKLLHRLWKALKVIWRRGKIAQPWRYAEGVYIPKEEKSENIDQFRVISLLSVESKIFFSIVAKRLSNFLLSNKYIDTSMQKGGIPGVPGCLEHTGVVTQLIREAREGRGDLAVLWLDLTNAYGSIPHKLVEVALEKHHVPQKVKDLIIDYYSKFSLRVSSGQLTSDWHQLEVGIITGCTISVTLFALAMNMMVKAAETECRGPLSKSGVRQPPIRAFMDDLTVTTTSVPGARWILQGLERLVAWARMSFKPAKSRSLVLRKGKVRDEFRFRLGQHQIPSVTERPVKSLGKAFNCSLNDRDSIRETSTAMEAWLKAVDKSGLPGRFKAWVYQHGILPRLLWPLLIYEVPMTVVEGFEQKVSSYLRRWLGLPRSLSNIALYGNTNKLKLPFGSVREEFIVARTREHLQYSGSRDAKVSGAGIVIRTGRKWRAAEAVEQAETRLKHKAILGAVAQGRAGLGSLAATRYDSASGRERQRLVQEEVRASVEEERTSRAVAMRQQGAWMKWEQAMERNVTWKDIWTWNPLRIRFLIQGVYDVLPSPSNLYIWGRVETPACPLCSKPGTLEHILSSCSKALGEGRYRWRHDQVLKSIAEAISKGIKDSRYRQATAKVIQFIKEGQRPERTAKNCSAGLLSTARDWVMTVDLERQLKIPPHITQSTLRPDIILVSEATKQLILLELTVPWEERMEEAQERKRGKYQELVEQCRANGWRTRCMPVEVGSRGFASYTLSKAYGTLGITGTNRRRALSNNVEAAEKASRWLWLKRGEQWGQ

SEQ ID NO: 1411 - protein, 1085 aa, Takifugu rubripes
  MOD_RES (172)..(172): Any amino acid
  MOD_RES (744)..(744): Any amino acid
  MOD_RES (910)..(910): Any amino acid
  MOD_RES (944)..(944): Any amino acid
  MOD_RES (1056)..(1056): Any amino acid
  MOD_RES (1068)..(1068): Any amino acid
MTPAMEMTTTVTCICSKLCKNQRGLKIHQARMKCLEREVEVQRTGPGPGETQEEPGQEATHRSQSLHVPEPPNPNRVVQQQRIKWPPANRRSEWLQFDEDVSNIIQATAKGDVDSRLQAISTIIVSYGSERFGRIEKGNTETTSYTMNRRSFKIHQLRKELRTLKKQFKRAXDGDKQALKELYNILRKKLKTLRRAEWHRRRGRERARKRAAFIANPFRFSKQLLGDKRSGRLECSREEVNRFLQNTMSDPLRGQDLGPNRALISPAPPSAEFKLAEPSLKEVEEVIKAARSASSPGPSGVPYLVYKRCPEILRHLWKALKVIWRRGRVADQWRCAEGLWIPKEEDSKNINQFRTISLLSVEGKVFFSIVSRRLTEFLLKNNYIDTSVQKGGIPGVPGCLEHNGVVTQLIREAHESKGELAVLWLDLTNAYGSIPHKLVELALHLHHVPSKIKDLILDYYNNFRLRVTSGSVTSDWHRLEKGIITGCTISVVLFVLAMNMVVKAAEVECRGPLSRSGVRQPPIRAYMDDLTVTTTSVPGCRWILQGLERLILWARMSFKPTKSRSMVLKKGKVVDKFRFSISGTVIPSITEQPVKSLGKLFDSSLKDTAAIQKSTEELGGWLTKVDKSGLPGRFKAWIYQYSILPRVLWPLLVYAVPVTTVESFERKISSFLRRWLGLPRSLNSAALYGTSNTLQLPFSGLTEEFKVARTREALQYRDSRDCKVSSAGIEVKTGRKWKAEKAVXVAESRLRQKALVGAVATGRTGLGYFPKTQVSHARGKERNHLLQEEVRAGVEEERVGRAVGLRQQGAWTRWESALQRKVTWSNIMQADFHRVRFLVAAVYDALPSPANLHAWGKSETPTCSLCSGRGSLEHLLSSCPKSLADGRYRWRHDQVLKAVAESIALAISTXKHHHAPKKAISFIKAGERPRAGPQITTGLLHTAXDWQLHVDLGKQLIFPQHIATTSLRPDMIIISEASKHLIMLELTVPWEERIEEANERKRAKYQELVEECRGRGWRTFYEPIEVGCRGFAGRSLCKAFGRLGVTGTAKKRAIKXASEAAERATRWXWLKRADPWVATGTQAGS

SEQ ID NO: 1412 - protein, 1112 aa, Tetraodon nigroviridis
MATTQASVKPTAVATCVCGKICKNPRGLKIHQTKMGCLASVQPEQRARFSLSESREVPARAEPYGPQQPHSPEALGETQEERGQESPHSAQNLRAQVAQAPDNPQHHRRVKWPPASKVSEWQQLDEDLEGILESTAKGGVDRKLQTMTTLVISFATERYGTMEKRAAPEKYTKNRRAEKISQLRQELRVLKKQFKGASEDQKPGLAELRCTLRKKLLTLRRAEWHRRRAKERAKKRAAFLANPFGFTKQLLGQKRSAHLECAKEEVDSYLHDTFSDAERENSLGECRVLISPPEPACSFNTKAPTWKEIQTVVRAARNNSAPGPNGVPYLVYKRCPKLLARLWKILRVIWRRGKVAHQWRWAEGVWVPKEEKSTLIEQFRTISLLNVEGKIFFSILSHRLSDFLLKNQYIDSSVQKGGIPGVPGCLEHCGVVTQLIREAREGRGSLAVLWLDLANAYGSIPHKLVEMALARHHVPGPIKTLIMDYYDSFHLRVTSGSVTSEWHRLEKGIITGCTISVIIFALAMNMLAKSAEPECRGPITKSGIRQPPIRAFMDDLTVTTTSVPGCRWILQGLERLMTWARMRFKPGKSRSLVLKAGKVTDRFRFYLGGTQIPSVSEKPVKSLGKMFDGSLKDAASIRETNDQLGHWLTLVDKSGLPGKFKAWVYQHGILPRILWPLLVYEFPISTVEGLERRVSSCLRRWLGLPRSLSSNALYGNNNKLTLPFSSLAEEFMVTRAREVLQYRESKDPKVALAGIEVRTGRRWRAQEAVDQAESRLHHKELVGAVATGRAGLGTTPTTHLSRLKGKERRDQVQLEVRASIEEQRASQWVGLRQQGAWTRWEEAMARKISWPELWRAEPLRIRFLIQSVYDVLPSPSNLFLWGKVESPSCPLCQGRGTLEHILSSCPKALGEGRYRWRHDQVLKAIAESISSAMEYSKRLPLPGRGVRFVRAGEQPPPQPRAQPGLLATARDWQLRVDLGKQLKFPENIVETNLRPDIVLHSQSSKQVILLELTVPWEERMEEAYERKAGKYAELVEDCRRAGWRSRCLPIEVGGRGFAGKSLCKAFSLLGITGMRRRKAICAASEAAERASRWLWIQRDKPWTSASWTQAGN

SEQ ID NO: 1413 - protein, 1522 aa, Schmidtea mediterranea
MMDSRQLNTPKIRKYQNPKMTNDIMKSYNYAVLSDVTPQETTQTTTHLNVDIDNETTQPKQPLTKSGKPKSKPIAVSYKFKDATFIWDTTPQTNPPRDCTKLIDKTRPRKTIFKKSAFQSYLKKELSNETFVEVKTFLMATHKYRFKDENSRLLAYRIINRYVMETANEFKETEFDMARFAKFFTIPENWLKHLKPYSTATETSPADRIKVQKLVDLTCRYPFKTQEEQTSVANFLHFFTQRSIIGISRDYKFQKFIPFMARKNTRPETTSTMVTTSPTEQNRLPMVIITPLEEPKSEHRRPEKRGASNDTIVLSDEEFPLLKRRTLPTRKSKNPTGAGNVPTETECTDEVKFILNNEYQIECKECGKVWENVRNGLNHLRQKHDFPNRTDVMVSCVRCEVPIKGAECVNHIKNHKKDDKEESEAGSLVANTQDIPNESSLSQAAIEVYLRNILKMKENQERNIQYLEPSTANFLINRNLRAFYQNVKIEKLIGWEQVIWLIHWNKCHWIVYLANCDSKTSVILDSDNQMTLQQRCNIKAKFDKFLEGTFEEKTVLGTLERKVPQQPNNFDCGIYVIQYISDFLKDPQRIDYHTPDSKRIRKEIGELILEEMKNPASKIKNPNKEIQSLLQKFRLLQINVNDVFHWFAAEYQKSLPKIRTKRDGKLNKLSCSYQIQRLFGLAPKRAVKEIYFQETSTADLETRVLNEHFKKDESTMKECKIKNGNHYQDWITKAQIDNKEILEALKNSTDSAPGEDNIPLRQWIIWNNDGVLFDMFNYIKRTHDIPDMWKNYTTTLLIKPGKSQESNIPANWRPISILPTSYRIFMKVLNKRVLEWANRGELISKWQKAVDKANGCDEHSYVIQALIEKANRSYYKNEQCHLAFLDLADAFGSIPFQVIWHTLKNMGMDEETINLLKEIYKDCSTKYKCGKNESEKIKITKGVRQGCPLSMTLFSLCIQYLIQGIAEKKKGATIAGQEVCILAYADDLVIVANTAKDMQMLLTTIENLAKQADLIFKPAKCGYYRDPRDKKSMMKIYGKEISIVDEKNVYTYLGVRIGDTKKKDLNVRFEEVKKKTTAIFKSKLRSDQKLEAYNIFCQSKFVYILQGEDIAKTKIETYDEEIKKMIKEDILKLQDKSPFTDFVIYSPREKGGLGITKIIDEQTIQTINRTAKLLNSSHRAIRAIIYEELIQVANLRGEKEINTIEEALKWLEGTNKYKKNSNAKTTWITRVREAFQTLEKKHKIKVRFVPKENCIGYKIKCDTQEKIVELDNSKELSKSLHWMIKEAYYKEWKALKCQGYIISLKTSEFMEWKMPRGLPDPDWRFLTKVKANMLDVNMKQANQGGRLGSTKCRKCEDKESASHVINHCASGNWSRVEKHNQVQNELAKELTKRNISFEKDSIPKETKESLRPDLVIRLKDKIMIVDIKCPFDEESAIESARNKNIDKYRELAKEIQAKTGLQTTVSTFVVCSLGTWDKRNNELLRQMGIRYEESKEMRINMIQKAIHGSRKTYDHHRNFNNG

SEQ ID NO: 1414 - protein, 1870 aa, Caenorhabditis brenneri
  MOD_RES (4)..(4): Any amino acid
  MOD_RES (151)..(151): Any amino acid
  MOD_RES (153)..(154): Any amino acid
  MOD_RES (187)..(187): Any amino acid
  MOD_RES (202)..(202): Any amino acid
  MOD_RES (245)..(245): Any amino acid
  MOD_RES (250)..(250): Any amino acid
  MOD_RES (1545)..(1545): Any amino acid
  MOD_RES (1547)..(1547): Any amino acid
  MOD_RES (1679)..(1679): Any amino acid
  MOD_RES (1774)..(1774): Any amino acid
  MOD_RES (1809)..(1809): Any amino acid
MPLXISDCVHLVSAEGDTMNGRSTCGPLSRSSSVVSRSRSSPSPSVPPHPSPSIGPDTGLSAGIIGTSRGCSLWLPEVDNALSQWLRKGLERDHEVLVCGFEAAKPLSLSKARLLRKTPRNTGVVRHILEFDGRLVHTNCNETECVLSTLXSXXAVEVVRISLKCEPREPCEPKCVLSILCSDKIVXISFECETREPFPFFXDRKFREPIPFVFERMYDPRDPIPSFICWMYDLRQRMTPGTLPXNPLSXENKDSWGRPAVIKNEIRSMRSYLEENVKENRLNLLRRLRGGGEGKKMIRKLVAEKKSDTEAVCRILYPLDDRYECFVDGCETTSTMGYGSSDLKYMTTHIKKEHGVKVQWTYECSLCNKQAPFMGGAASKWVTAHMATKHTETVKLKLKPSISTTAKVAAKLDEIAVSLPKPRQVRVLRDPDEVKEKVAKPTLASTREEVKRNALRNMAPLVELSSQNQLTGAERPEETSEAMRLEECRTPEKIAELEGKIQTRTVTKKLSALKESMEKRTREEKVGKPSLAPIHEEVKKTARRSLAPLVEPSTFTHLTGASRLQAVRDAFSKANKDAAAKRRSSLAKPARLSEIMNTTFTKETVNETKEPVNDTDESIATIQPQVRVYRFNTWCLDHETTREAWLTGEVVDWFMGKVTEKKDQYRVFDSLVWSMYKFHGVGYVLDLMRDPLTYFLPICEHDHWVLLVIDEKGIWYGDSKGAEPCREIAKFIEETKRERRMFPVPVPLQRDGVNCGVHICLMVKSIVNGEPWYTEEEVKVFRRNVKRGLKEFGFELYSERIVYVGDDSIKVNDEHDDDVVFLSEETNNTTFTIEQAEDPAEEDAQHLESPVKPVKLMELKIPKIEIKKKEIRRKPKQQIEKKRKVPTGKPDELLVRVRLWLEREVQSYFDSGKRFQRLEWILDVLTAAIHKATAGDEQAIERIEKRSPPLEVEEGEMSTQTEPKKRERKEKESGCEMKASHKEMYFKNRSKAFNVIIGKDSKQCEIPIETLQKFFEGTTAETNVPAEVLKEMGSRLPKLEALDWMEANFIESEVSDAMKKTKDTAPGVDGLRYHHLKWFDPEYKMLTLLYNECKNHRKIPSHWKEAETILLYKGGDETRPDNWRPISLMPTIYKLYSSLWNRRIRSVGGVMSKCQRGFQEREGCNESIGILRTAIDVAKGKRRNLSVAWLDLTNAFGSVPHELIKSTLESYGFPEMVTEIVMDMYRGASIRIKSKNEKSEQIVIKSGVKQGDPISPTLFNMCLENVIRRHLDSASGHRCIKTKVKVLAFADDMAILAENRDQLQTELNKLDKECESLNLIFKPVKCASLIIERGMVNKNAEVVLRGKPIRNLDENGSYKYLGVHTGIATRVSTMQLLESVTKEMDLVNQSGMAPFQKLDCLKTFVLPKLTYMYANAIPKLTELKVFANLTMRMVKEIHEIPIKGSPLEYVQLPPSQGGLGVACPKITALITFLVNVMKKLWSSDSYIRKLYRDYLDEVAETETGMEEMTKEDIAKYLSGDVPIDKKAFGYNTFTRVRDVCNSLTXIXGAPLHKLKIVERDGDFAILVQATKEGMEKIFTCAQEKKLQQLLKAEVNTALAHRFFTEKPVKSAVMSVMRQYPQSNAFVKNGKNVSIAVHSWIHKARLNALHCNFNTYGENKSKVCRRCGKDVETQLHILQXCEYGLPKLINERHDAVLHVVRNLIRKGSKKDWKLKIDETVSSCNQLRPDIYMCSPDGKEVIMADVTCPYESGMQAMQESWNRKVTKYEGGFSHFXKMGKKFTVLPIVVGSLGTWWKPTTNSLVQLGIEKXTIRRVIPELCSMTMEYSKDVYWNHIFGDTFRKPPMRFGVEKPKGNSWKKEGSEPKGAASSD

SEQ ID NO: 1415 - protein, 2030 aa, Caenorhabditis japonica
  MOD_RES (53)..(53): Any amino acid
  MOD_RES (67)..(67): Any amino acid
  MOD_RES (169)..(169): Any amino acid
  MOD_RES (222)..(222): Any amino acid
  MOD_RES (274)..(274): Any amino acid
  MOD_RES (342)..(342): Any amino acid
  MOD_RES (351)..(351): Any amino acid
  MOD_RES (626)..(626): Any amino acid
  MOD_RES (1031)..(1031): Any amino acid
  MOD_RES (1077)..(1077): Any amino acid
  MOD_RES (1239)..(1239): Any amino acid
  MOD_RES (1424)..(1424): Any amino acid
  MOD_RES (1437)..(1437): Any amino acid
  MOD_RES (1550)..(1550): Any amino acid
  MOD_RES (1726)..(1726): Any amino acid
  MOD_RES (1745)..(1745): Any amino acid
WRRPAPKQTKNSSLHHLGHEVKRIARLKPGIFEFHAKPKNSSLHHLGHGVKRXARLKPGIFEFHAKXKNSSLHHLGHEVKRIARLKPGIFEFHAKPKNSSLHHLGHEVRRNSRLKPGIFGFYQKSKNSSLHHLGHEVRRIARLKPGILEFHAKNRIKSGLKVTFLSDLXAHAGALACSRFLASTLKTEHCRQKSFKPVGFLLHFLKNSSINEVASLRNVKKXFLEFFSGKPIGGMASFSRTKITFFKLCLKNFVLSAENPPIIRQKTNQNKASXVQIARGGHLSDCLPSQKMAGVLGRLFLSVQSTLSHRPFDTLLRSDDDKRGRKTIKLQFFIKENLVTPXVARDVKILXKQTKNNSGNSDSNSETKNFSKNKVSRQNGPLIGGGNHKKIGENQITRTLEIESKSDDNKVLVLRILYPTNDWYKCYSQWCQHKSLVGYGAHDLKYLTDHIKSTHSKKVEWSYQCSICDAKAEGTGTKAARWITAHMPKVHGIEATHRIKQNSEKTTNVKTANSLQEMALSLQKPKNGPKKVVMATSTTPEKKISELESKIQTREVAKQLSALKESAQKNQQGNKTKNVKSSLKTIAENTNETKKISARKSLINYLKPEDVLNHIPKEPKPASAKXGLQELTGAQRLQETRRRFMAGNRRDSIARRESLSLGKISNSFKIELKNAPEKTTLKKPAVTQKQNTSQNVSSSTVVKENKTGNDVITIDDTETVKRKINTWCLDHESTENAWMADDIIFWYIQKQIEISLDNKKFKVIDPLIWTTYRIYGVECVQDELVGFEKYFFPICENGHWVLLIIDDKRVWYSDSLADKPIEVIEDLINKLNRTQGKFNQTVPKQKDGFNCGVHVCLVAKSVITENFWYTEKDVNDFRKTVKLWLFSEGFELYSEPYKQIQNKNISVNSEKNQISDNEKNWGDKTQTVNESTLKERDEDIFLLRPHISVGVALKTEDEKNQKAENLKAPQKLKAIRRLKILKTCLKKLTAVKGKPEETERAAIPNLMAIKLKTPPKVEPVRRNPEKGENYXKSQPNKKRQIPTGKPDELVKKVREWFEIQFQAYFEDGKSFQRLEWXTGLLTAAIHKASAGDEQAVGKIIKRCPPLEIEEGEMATQTETKQKPKNQKSTKGANSSSSIREAYAENRARTFNKIIGKDDKCEIPIEKIEKFFENTTSNTNVPTETLARITSDLPKLEIGSWIEEEFREKEVAEALKKTKDTAPGVDGLRYHHLSWFDPKXKLLTKLYNECREHKKIPGHWKEAETVLLYKGGDETQAENWRPISLMPTICKLYSSLWNKRIKSVTGVLSKCQRGFQEREGCNESIAILRTAIEAAKGTKKSLSIAWLDLTNAFGSVPHESIEATLIAYGFPGMVTEVIKDMYNGASIRVKTKNEKSKQILIKSGVKQGDPISPTLFNICLESVIXRHLKSADGHKCIXSNIKLLAFADDMAILSDSKTKLQQELQKMDDDCTPLNLIFKPAKCASLIIEWGKVQKDQKIKLKGQFIRSLAEQDTYKYLGVQTGIETRVSAMQLMKKTVSELDKINCSALAXWQKLDAVKTFVLPKMTYMYANTVPKLSELKEFANITMRAIKVMQNIPVKGSPLEYVQLPIGKGGLGVACPKTTALITYLVSTMKKLWSTDDYIRKLHTDYLKMVAIKETKTKEVTLEDLASYLSDDKTVCKKAVGYNSFTRVREICKTLSKNKGALLSQLKIIAKDGKLAILVQAXKDGKTKIFTHDHVKTLQKXLKKEINEALLHRFTTEKRVKSEVVRVVQEYPQCNSFVRDGGKVSIGAHRFVHKARLNLLACNYNTWQDAATKQCRRCGYEKETQWHILSSCPKSMGGKITERHDSVLKTVKEMIQTGSLKNWKLKLDHELPGSTRLRPDIYLRSPNGSEIILGDVTIPYEHGIEAMQTAWQKKIEKYEEGFKYLRSTGKKLTIVPIVVGALGSWWKPTTDSLVSLGIDKNTVKRAIPEICSTVLEYSKNIYWNHIFGDSYQKVPMFFGGEKPKGQSWKKVKPPEGKTASNHEPPG

SEQ ID NO: 1416 - protein, 1719 aa, Caenorhabditis remanei
  MOD_RES (138)..(138): Any amino acid
  MOD_RES (766)..(766): Any amino acid
  MOD_RES (797)..(797): Any amino acid
  MOD_RES (966)..(966): Any amino acid
MTVFIDRGIGERGQMAVCSLHRYFSFSPFSPIPPYVNNGSFGENGCGTDKSLLPVIEVVVREVKINWSENILVVECLIMVKSGERVVVKRQNLEKVIQNLARINSTLFSNLGNQIFCVVPRIKDSTNKEQGYRKEKQXKFHVSFRSIKSQVPPYLRGGGDVMEDTEIRGIRKLEPEAQLDSSKPLICRVLYPTQGYMYKCFYPKCKGHSNGSTDLRSLKKHMVDKHFTNIEFAYKCATCMFLTTGKSATALKSIKAHMASHHKVTMEPGKKSLVQKLNARLEEAAPSLPMPRNRSKVIQLTPEKSISELEKKKQTRSVAKQLSTLKESAQKKEEEVKIAEVKKREPRLSIIPESNVRRSLAAGLEQCINPEQSVAQRIREKREEYAKASREAAAKRRSSLAMKPARLPDKENEITLQETKKIDDPIVIDLEKECILTTVLQVPRNQFNSWCLEHETTIDAWLTDEVIHMYMCTITENRKYFMAIDPVLWPVYVRNGAEDLLRRTSCPGTFFFPICESNHWVLLVIEHDVYWYLDPKGEEPKGNVEILLESMKRKRQYYEFPPPSQRDNVNCGVHVCLMAKSIVDECGYNWYSEEDVRSFRTNMKDILKSKGYELCPEPYNRQNLLKTEKQKEVILEEMIDSFVVEDDMTFTVHRDSDHGDDEVEHLKTIEQEPENEISEIENVEGSVDSVIPKLMEMRVQTPPVINEKRGKKRVSAKEKPRKQKEKEQKVPTGKPDELVKRVRVWFEKEFKSYVEDGKSFQRLEWXTDVLTAAIQKASAGDEKAVELIEKRCPPLEXEEGEMCTQTEKKKKPKSGKGNGGQESMKSLMASYSENRAKTYNRIIGKHSKQCEIPIAKVQKFFEGTTAETNVPKETLKEMCSRLPKVEVGTWIEGEFSESEVTEALKKTKDTAPGVDGLRYHHLKWFDPELKMLSQIYNECREHRKIPKHWKEAETILLYKGGDESKXDNWRPISLMPTIYKLYSSLWNRRIRAVKGVMSKCQRGFQEREGCNESIGILRTAIDVAKGKKRNIAVAWLDLTNAFGSVPHELIKETLESYGFPEIVVDVVEDMYRDASIRVTTRTEKSDQIMIKSGVKQGDPISPTLFNMCLESVIRRHLDRSVGHRCLKTKIKVLAFADDMAVLAESSEQLQKELTAMDADCSALNLLFKPAKCASLILEKGIVNRLNEVVLRGKPIRNLMENETYKYLGVQTGTETRVSIMDHITEVSREIDLVNMSQLAMHQKLDILKAFILPKMTYMYQNTTPKLSELKVFANLVMRSVKEFHNIPLKGSPLEYVQLPVGKGGLGVACPKNTALLTFLVTIMKKLWSSDSYIRKLYTDYLEEVAKVEIGKFEVNLNDLAEFLSDERAVDSKLFGFNAFTRVREVVRSLCKNKDSPLHSLKIIEREGKLAISVQATEESIEKIFTEDQEKKLMYLLKGELNTALQHRFFTQKVFKSEVMRVVQQHPQSNSFVRNGGKMSFSAQRFVHPGRLNQLPCNYNTWAKGRTKLCRRCAKNENETQSHILQVCDYSIGNIIKERHDAVLYKFRELIKRGSKGHWLERTDRTVPNTGSQLKPDLYLESPDGKHVILADVTVPYERGIEGMQKAWNEKINKYTDGYKEIFRRQGKSLVVLPLVVGSLGTWWKPTEESLIKLGVEKTTVRRIIPETCGMVAEYSKNCYWRHIYGEKYVQTPMINGGKKPEGNDWKKCEKGIEVPKVTN

SEQ ID NO: 1417 - protein, 1888 aa, Trichomonas vaginalis
MIPVLGTGGPEKLPLQSYVYCGNTAITDSFTPTAKTILKPEEQNLDIVLKNIAALNPENYSDLIRSLSKMEFRLDYPKEIENYWISEKLFSQSIASLPISLLVASMFSPEDRDLSTEPFHCNADGCNFHCDNCERMVEHIREHHNTDPMINTFETTEDTFRRITAIKIDKTGIEELNPLKYRCSYCDELFTEAEDHAIHMISHLTEKLSPDISFFFNDILRLYKTIDKPTVQNLFPETQVAIFDTLEETNRFRLIVGREAIETIEEAFPPSPPGTDRKPSIIITDTCQLRFVPCMDEPPKGDLGILTLLLRDFSAHNIPIKSLNNKELIADKDIDYSPDFVEGALANAEEHDTTNSQNNNGRYINSAEKLTEFLIQCEDYLTNIKTLEDLERFYTTIKDYRVNKEVIAEDTPIFVYFLVEEGKLPKPGLRCPLESYEGHEDKAFESLRKLCDHFKGEIAKTSFDPKVHTIDIWVEFLAQAYGTGTFVYKDENGNIDLDTHVFKCPYADCSYTNNDRSKLMDHMKTKKHAKNVYIERYGFFWGIVIEGVNRPKGIVYPTLKDIKEHACRKCPEAGCNTYVTELSDIKEHLKKKHKSTTAGVDGEIAHTDATYCWITKEELDALHAERARERAEQVDNTPVQQIINADNNEENNENQEDNGNNEEADALDPPNNTTETEDEAVHAVIINPPATEEEEVAIIAEARRNIPELQQAEERGCVTPKMTSLVRLKLLKGGGELFNKKLTPLATRYAATGNTEADKIKVDYLTLKCNAALREMIYTNNHSESKFMTAENGEDTAPPPRISEDTRDRIQKAANEIKGTLIKVVKHISHARCLKDSTRDDEHNKFVEMIAKIKNDLRDNKFEQYNIEEIFQGPISDQSILNIVNTEDNNEFIKKMDYINRILGTPQDASPYARKKLQACFADNPTKTLRNIILADKVPQQSLKPSEYLDYYGPQWANEAEGYENFLHHDYALPERYGQVFANDFLDFMTNESKIIEVIRNKNHLSAHGLDGIPNSVYMLFPVSAAKFLSILFRSIIISGHIPDCWKLSKTVMLFKKDDPSLAKNWRPIGITSCTYRIFMTLVNKALQMIPMFHAMQKGFVRGATLSEHIAVANEVLCQSTRTQSEMFQTAIDFTNAFGTVPHQLIFDSLEAKKVPDSIINLLKDLYKGARTAIYTRHAHSEIVPVRRGVIQGCPLSPILFNCCLDPLLYAVQRRHFEDGYRFQDKAGQYSIAIQAYADDVLVISPTHEGMQRILNTVDEFQKIAKLKVAPQKCVTLAKTSTAIQPFRIGPDEIPIKTSMDNITYLGIPISGTKTSRFAAATGILEKVKAQIRVVFASHLALSQKIIALRVFILPQLDFYMFHNVFRVNDLKATDQMIRGLIDKEAPTSNIPVSFFYMPKNKGGFGLVKLELRQPQLVLTKFARLWLSQQAETKAFFHTMAQEEKSFRKVVEDQENGFLGIKMENGKIVQKNERSKRTNCFITQAAKAADKLEVRFKEWDKGGIQVRGVGENATDWYRSKHIGQISPLIGRVIQQRQYEEFKKDETHSHTFCEPAALAESHDIMKRPQAVPNNLYSAAIALRTNTAPTPANMHFHNPEVLANCPLCGCQSCTLFHTLNMCRNRFSLYKWRHNIICDDIYQFIHDHYPGVTIKCSARITSDGYQTTGPELDDTVKDLLPDLVVYDEANKMIKIIEVTCPYGTDNNVGNSLDAAYDKKVNKYKSLAEQTERLFNWTTTLSIIVVSSLGVIPLRTKLDALRISPADHIQLLKRLSMHAIAASACIVFEKVPEFFGMRCRPLPGRVTAPNAAIPPNNNENNNDTDHGQENQQATSEEQPTNNGNAQEDNGQGEQINNSTEQTISVDQIIEEDAENNAIEQALDQPDEDEFLN

SEQ ID NO: 1418 - protein, 1734 aa, Caenorhabditis brenneri
  MOD_RES (5)..(5): Any amino acid
  MOD_RES (8)..(8): Any amino acid
  MOD_RES (11)..(11): Any amino acid
  MOD_RES (17)..(17): Any amino acid
  MOD_RES (22)..(22): Any amino acid
  MOD_RES (51)..(51): Any amino acid
  MOD_RES (59)..(59): Any amino acid
  MOD_RES (62)..(62): Any amino acid
  MOD_RES (73)..(73): Any amino acid
MRYHXSNXPAXRTSDNXWRSIXKDVRRPDPSTIEEKSRYNRSIGIPDSLKXRSSAVRSXSSXPPSGPQDVRLXNSPSLDDRRRLVDCETTLGSYREWTDKPMMGKMTYAAVTKRAPPRPQTGGARLSTNLLADEMEIKYRDTNDIRLVIDLPNPHLIKCPLCKSCISARGRGANALKYMKRHIADAHHLNADFVYKCSRCQEHEPENVCGAKWIVNHLKRVHGYTLEDAVSTAKPSTRQQIANAFNDSAPFIDARKTSDVPEKKSREAGLEKFLAPTKSEDTREKTPPSTRKSSESSEASIQSTIQETLSESSDTLTVQEIINISSEDEMDEEPPKRRVNVWALIHENGKDAWIDSDLMVIFLESRARGYESCSIIDPLNFICTDMSYLTTIVRRRMEEGYKKIIFPLCANDHWTLVTITGSTATFYDPMGNEPTETVKKMIDELDLEMQLAPSNSPRQRDSWNCGVFVMKMAEAYIKDTQWDLTDVDTDVKTFRRSLLTELKAKFNIFAEDIQTYRPPSRKALTRNSQSPVVVCHKCSRPATPIQDVSRMEVEEAPVLVPTPEEPPQEWTFVGKNRKRGVTSRTPNTSPEAKRPAFPPVPLKPSANRWHFPEEETEKMEVSSADEVKNSTPPKPPKIPNLLAMKIASPVPLKRGNPSKKHGKGHMMNTARKGPTKKEMPKGEPANLIVKIRSWFDEQLKMYKDEGSNLQRLTWLSDSLTAAIGKAFNGNKYIVDQIIKRNPPPLVEKGAMSTQTSRKRDEFKPRERMAQEPNEPLRIQYAKNRQKTFFKIIGKQSEQCTINIETVEQHFRKTLKAPVVSENAIKTVCGSIKKVLMPKTIEDPISSVEVKSILTKVKDTSPGTDGVKYSNLRWFDPEGERLAKLFEECRKHREIPSHWKEAETILLPKDCSDEEKKKPENWRPIALMATIYKLYSAVWSRRISGVQGVISPCQRGFQSLDGCNESIGILRMCIDTASVLNRNLSCSWLDLTNAFGSVPHELIRRSLESFGYPQSVIQIVTDMYKGATMKVKTADQKTQSIKIEAGVKQGDPISPTLFNICLEGIIRMHQMREKGYDCVGHKVRCLAFADDLAILTNNKDEMQEVIDKLDADCRSVSLIFKPRKCASLTIVRGAVDKYAKIRINGDAIRTMADRDTYRYLGVKTGVGGRASETEALIQVVKELQKVHETDLAPHQKLDILKTFLLPRLQHLYRNATPKLSELREFENVVMKSVKRYHNIPIKGSPVEYVQIPVKKGGLGVLSPRLTCLITFLTSTLCKLWSDDPFISSIHKDALSRITVKAMGLTTQSATIKETCEYLNTRKAVTKGGYSLFCRMNESLRTLSVIQGAPLKSMEFIPVNNEIGIAVQATKDSEIKVFTKADSLKLMSKLKDLVRSAMLKRFLEEKSVKSRVTQVLQHHPQSNRFVRDGRNCSIAAQRFVHPARLNLLSCNANTYDVNHPKGCRRCQADFESQQHILQNCHYSLAGGITQRHDRVMNRILQEIGNGRKAHYKIMVDMETGATRERPDIIMEERDGPEVLLADVTVPYENGVQAVERAWDKKIEKYKHFLDYYRKIGKKATILPLVVGSLGTYWPDTSHSLKMLGLSDGQIRNVIPEICQIALESSKNIYWKHILGDSYKTVEGLFCQRNNKEVRFEGKGEKHHVSQRFQPLKCEKVRTMKSTKEEGRSRSNAKKGPNWRRSKSESDGRSVSKGRYWRDPSNKPPHSKMTQSALAKR

SEQ ID NO: 1419 - protein, 1723 aa, Caenorhabditis remanei
  MOD_RES (255)..(255): Any amino acid
  MOD_RES (658)..(658): Any amino acid
  MOD_RES (1425)..(1425): Any amino acid
  MOD_RES (1494)..(1494): Any amino acid
MTNVYLKPVNDNQTNKTGDNSRNTMSNSQCEMTWKPVARTYAQAASTNPADDKTVTVLGCKYNLLKLGNTPQTSKRSPPKPSRGGARISSVYTLTDELEITHREEGKITFAIDLPNKNNILCPLCRECTQTRGRGSSFTKHMKLHVKEKHQLDATFIYKCSMCNEYEPEKKCGTKWIQTHLQKVHNYKYDESAIVVPVPPNTRQQIANELNNAAPFVDIRKPKAAAVEEKKTENGALLKFLTKSNKDDQVKSPSXDIPDAESPEKETQALTIDPKGNNSPSKSSIRSSQSSASSVCQEIQEIITLSEDEDPKGARPKPGINVWSLINETGKDAYIDTDIMMAFLKMRVENCDSVNIIDPLNYQFPARVDLVPLIQRNLEDGKKRVVFPICADEHWTLLTISNGIAAFYDPTGSRMSSYIEELVNELGLIIPKEQDEQPRQRDSYNCGVFVMKMAEAFIQDTEWEMEEVEEDVKNFRRNLLEELKPNYEIFAEKIKYYNSPGKSFAQSRPTSRSSQCAVCPTCSRSATPMMDVGNMEVDPVPQQQETPKSREPEQDEGWKVVGKARKRGVVTERSPNISPEAKRQFTGPEIKVVSPGKFHPLVGETEEMEVTCDSPPTKEPTTEPKVTPSLPAMKIASPEVTKKQTSKKKGKYGKKKQXTKKAQPPKGEPTKKAQPKGEPAKLIEQVRTWFDKQMKSYQEQGSNIQTLTWIADSLTAAIFKANSGNKYLVDKITARCPPPLLNEGEMATQTSRRTEAVKPKDRFVKESNEPLRIQYAKNRAKTFNVIIGKHSARCEIDINVVENHFRQTLKAQPVTEEALNTVCSGIKKAKVDPSIEGPISSGEVKAILAKIKDTSPGTDGVKYSDLKWFDPEGERLALLFDECRQHGKIPSHWKEAETVLLPKDCTEEERKKPENWRPISLMATVYKLYSSVWNRRISSVKGVISDCQRGFQAIDGCNESIGILRMCIDTATVLNRNLSCSWLDLTNAFGSVPHELIRRSLAAFGYPESVINIISDMYNGSSMRVKTAEQKTQNIMIEAGVKQGDPISPTLFNICLEGIIRRHQTRKTGYNCVGNDVRCLAFADDLAILTNNQDEMQDVLNQLDKDCRSVALIFKPKKCASLTIKKGSVDQYARIKIHGMPIRTMSDGDTYKYLGVQTGNGGRASESESLTQIAAELQMVHDTDLAPNQKLDVLKAFILPRLQHMYRNATPKLTELKEFENTVMKSVKMYHNIPIKGSPLEYVQIPVKNGGLGVMSPRFTCLITFLASTLFKLWSDDEYISSIHKKALSRITAKVMGLKTQKATLQEQCEYLNTKKAITKGGYSLFSRMNEAIRTLSVNLGAPLKSMQFIPENGEIALEVQASENSQIKVFSKADSMKLVTKLKDLVKSAMLKNFLENKKVKSKVVQVLQHHPQSNKFVNDGKNXSISSQKFVHPARLSQLVCNGNSYSKDLPKNCRWCGYECESQAHILQHCTYSLSSGITQRHDRVLNRILXEVIKGRKNNDYYDIMVDTEPGPTRERPDIIMIQKDGPEVLLADVTVPYENGVVAIEAAWDWKMEKYSHFIDYFARLGKRAVILPLVVGSLGTYWPDTSNSLRMLGLSDGQIRNLIPDISMIALESSKQIYWRHIFGDSYRIVSDLYCRKDQQEIRFGDEPMENVQVSDRFQPFKTREREKKSEEEKKRRSKSKKGKTWRGSKKQTDSRQSGKSNQNQGFQRSVGQGVSR

SEQ ID NO: 1420 - protein, 2017 aa, Caenorhabditis remanei
MTKTEWSWRHRSRSRSVGIVVKIDTSDYANVRVHVAADLSNEDGHTSHNNGIILPIPMKPSVDRFCQIQYPPRGYYVPHPQSQKGHDAKPSRHWNEEAQPPYYHNNNHGRRGRSAKPSGRRPPRKPILQEESLAAHPQIPGDTASAVPLYSDVVNNENKSQGKPPQGSHRRSGRPGTKPSVPVGEAEQETNSRPIAPEPIVKFKHDKHGWTTVQGSHSSGRPVPKPSVPVVSEANRFQLLQEGDFPPLTTSESSQEEIKVPNYQRIVSPIPLPSEEDSKLPTKSNYRAPKGRKSRNYKKPQQQNPKKYQQRLPYQPKVNNAPTDRMAPEQLKGGGGKTAHNDIEEMEIEEDTDEKIIQVKRIKIVNKLTPHHFVCMMTYPTDNIYRCFVKGCTATSQGGWGAEDLKYLTVHIRQEHKIKVEWTYECGICGDLSGGAGKHISKWIKPHMRKKHNRDAPTNFKMGSRSSGKPKITELLEESAPSCSNPRRKTLNQKKTAIITQVTPEKLKTGYQTRSVTKALSVLKESRQKELEVLREEEKANAKQKSKLHPFFTKAPHIDGVKPTVRRELSKMITPGGEHKGTKIPMVHTKRGLIQKINRKAKKAKPMHLDESTIIEASQLDVITIDDDDEDDNMTPMRRRFNTWCLDHETTQEAWLTDDVINWYLKDLCFGNEQYMLVDPLVWLIYKMGGMAGVEQRFKSKKTCLFPICEADHWILLVFDETNLCYANSLGSQPNGQVKNFIQQLNRKLCSFEKEVPLQKDSVNCGVHVCLIAKSIVNGQFWYDDSDVRTFRTNAKAALKAQGYELFSEAPKQIENPDSSHREDIKENSMEMCSESLMIVATPQRSEAPMELVDTEPSDLESPKSDRVVYEDCITALSDVSEPRMTPEKSETPEVPVVEERDLDWPKLESPKSDRVVYEDCITDLSDVSEQRMTPEKCETPEAPLVVECVELERLPKDLPVTDRSTVVAIPEAVKLEEKSEVVIPRLMELSYTVPPEPSPVVEYTQPYTHTHTKPKVKATCQMGKKRKVPTGKPDELIQIVRQWFEKEFNDYVTEGRNFQRLEWLTNLLTAAIQKASAGDEETIEKIRKRCPPPEVRENEMSTQTSQRQKPTTTNQKKRSRNTTQSDTQANTYWRNRAKTYNQIIGQDFKQCDIPIAILEEFYKKTTSVTNVPQETLVKVTSRLPRLDIGKWIEDPFTEQEVFGALKKTKDTAPGTDGLRYYHLQWFDPDCKMLSSIYNECQHHLKIPAQWKEAETILLFKSGDESKPDNWRPISLMPTIYKLYSSLWNRRIRTVKGIMSKCQRGFQEREGCNESIGILRSAIDVAKGKRSHLSVAWLDLTNAFGSVPHELIESTLSAYGFPEMVVHIVKDMYKDASIRVKNRTEKSEQIMIKSGVKQGDPISPTLFNMCLETVIRRHLKESSGHKCIDTRIKLLAFADDMAVLAESKEQLQKELTEMDEDCTPLNLIFKPAKCASLIIEFGKVRTHEQIMLKREPIRNLNDDGTYKYLGVHTGADARTSEEELIISVTKEVDLVNRSALTPPQKLDCLKTFTLPKMTYMYANAIPKLTELSAFANMVMRGVKIIHYIPVRGSPLEYIQIPTGKGGLGVPCPRITALITFLVSTMKKLWSDDEYIRKLYNSYLKKVVEAETGIVEVSTKDLAEYLSNKVPSRKHEFGYNCYSRIREVCNGLALNQAAPLYKLEFIEQDNELAVVVQPTEESKERIFTKDHVKKLQSLLKASVNDALLHRFLTTKPVKSEVVQVLQQHPQSNSFVRMGGKVSISVHVWIHRSRLNQLTCNYNIFDPKQPKNCRRCGYKNETQWHILQDCTYGWAKLIRERHDAVHHKVVTMICAGAKKNWGRKIDQELPGFTSLRPDICLTSPDGKEVIFADVCVPYSRTRNIEFAWKEKIRKYTEGYSHLVAQGIKVTVLPIAIGSLGTWWTPTNESLYQLGISKSDIRSAIPLLCSTVMEYSKNAYWNHIYGNSYTSVPLRYGHQKPDGDDWKKELSCEPVLALQQ

SEQ ID NO: 1421 - protein, 1560 aa, Schmidtea mediterranea
  MOD_RES (326)..(326): Any amino acid
  MOD_RES (367)..(367): Any amino acid
  MOD_RES (588)..(588): Any amino acid
  MOD_RES (755)..(755): Any amino acid
  MOD_RES (909)..(909): Any amino acid
  MOD_RES (1171)..(1171): Any amino acid
  MOD_RES (1315)..(1315): Any amino acid
  MOD_RES (1389)..(1389): Any amino acid
MNVDLDATIKSIGMNTKETTYPNSQLRVETTPCTSTTIMHASCNTTSTISYSPLPSAVSLPESPASSITITTTDDNCDIIETPYPLPQTNGDLSEILKDIEANKDTTMSNKVLDCDSDSGDDRDMIIENDRESDMDLFSQSLLNTNQSDERREKNLTENAPTEITTEKSYFDIISKASDNTTSKKLLNVKNELTAGLPPMPPVTNTAKFIRNVRPEDIADPTLYRLDSRGKLGCRTQYKKPGCGDIAVYDYEAIVEHAAFIHTIPFNEQNNVDCQPCHPKKGKDVHTIVLIKYADIFNHIEAHSHVVQTAITDNMKTYLRLTKENXFYCSYRNNKKKNKCKKAFNLESNMMDITEHMKTHTGYSFDXNLNILCYCGIWKPFTELIAHIKTEHLQEYINSIPNKENIHNTTTIVSPLNFAGILASGETQNIPDEEIIKPRDLPENLAFNRNIENELSWSQHLVKAYIFSYAVKTSTIFINPYTCNALIQCNYKTFFETFPFKDFAKWNEIVLPIHNNTSSWSFFFLNKKKRVAMIIDPTADDSHTLHFELATDILRTILNVQNIFEDLNFPLTEVEYPVCHEANLSAFXVCHFLKCLMSDLPIDIPDIDHMKETMRPIIRKYNCAKFPESDVRNYRVLIEDLIYQLNLDTITCEEILCEIERINGRLNPKRYFKESKPKTDIIHLQKKKSAELLCVKRLKFQISQKTEIGKIWENDDVDHRPPMARFLKTFASQDCPVSNTSSINLPYYMDTDTDXCTDCENLSHIMKNLDSSAPGMDLITGGDWKKISPKHELITAICNCILRNKVCPEKWKLFRTVLILKPGKMSESFRANSWRPLAIMDTAYRIFTTLLNNRLLQWIRNGNLISPNQKAIGIPDGCAEHNATLHFAIDRAKRCKTELHIVWLDIADXFGSLPHDLIWYTLANMGLKNETLTLIKELYKDVKTIFDCQGTLSEPVPITKGVKQGCPLSMTLFCLSIDYILKSILTNYPFLLHDLNISILAYADDLVLLSDSYLEIKKSLESTVELAAFANLKFKPSKSGYLSINNVNSDILKLHLYNEEIPTISENNKYRYLGVDFSYKRNQDVDGRLGSALALTRSLFKSYLHPAQKLNAYKTFIHSKLIFSLRNCVIGHRILDCDRNRVTQGREKQLGFDQEIKALLKTMIGDKFQAXNNYFPYTHCKLGGLGITSAIDEYLIQSITGITRLFHSSNLSFRKMLITELAHSRGGKNFEAGLKWLNCEVNKAFPNTSFFVKFQKSALALKRKFCICVNLKFVEDNFSLEMTYKKRTSYVNHQNLSTLSKELHDFVGLYYAEQXCQMRVQGHIATAIGDSITAKYLIASDILNDAQYYFLVRARNNLLNLNYNAYRLKYNIGTKCRLCHLDEETQAHXFNHCRAKPNARRVKHENVLVSIVAFLEKIGFEIDVEKSPKYISIPTKLKPDMVIRSKRNKDIHVLDLKVPYDSGEGFEKAREDNYVKYKDLAIEIGKAFNQKATISAVVIGCLGTWDKKNNAALSKIGLTKTEIISLARIACPNAVIACYHIYREHVSFTKSAMALPFSLA

SEQ ID NO: 1422 - protein, 1171 aa, Girardia tigrina
TTGRNLGQWSCYSRSIQQSNYSFKLSSTEVGELVEQSPAPLQSPQFSNNYNNLNINNNLYYSLNTFNQSNNLCCLVNIEFFPTQHLLGDIVNSGCINYMNNYNNFDNINLYINSNVLSYNNYNHSFLASPYTTNITEHADINMHVQEVNMQQDNNTQHAITQQVSLQATSLQHTLDEMIVQFNTAVRLKKKHKVAKIFRGHNHRKDLPTLPAREQYKTKPKLAIREVLHRKTTATSSPSENAIKAFFSSYSRPAELFTGQELLESSWFPVHPEDDFEFRIPGRDQIAKYIKFASKSAAGLDWITYEDIKLGDPSGEILQPIFEYIVQNNICPSEGKASRTIMIPKPGKSDYSDPSSWRPITITSAVYRLLMKYLTWELYNWILLNQMLSRSQKSLGKFEGCHDHNAMLNMLIQDVRRQTNPSNPINKNKRLYIVFLDFTNAFGSVPLDTLMYVPQRFGLGTSALTLIKNLYLDNYTNVTCGESKIENVKLNKGVKQGCPLSMLLFNIFINIIIRAIEAMPDVHGYPLGDMDIRILAYADDIALISDSHKDLQEMVYKAEYIGRILGLLFNPSKCALMDIPHDKKRTPPILVNGEMIKCVGKADPYKYLGTFRSWFRKLDIKELLQMMMDETKLITESNLHPHQKIHAYETFIHSQLPFHLRHSRIPFSDFITNRKTNKTTNNSNDSEKSIQKAYDPESGQLFLNTFALPSGCAKDFFYITKDAGGPQLTSGLDEYLIQSIMYIFRLLGSEDPTLNSAIKHDLISHLNLKGFVNINFSQAISIFNSNFTDRTDHFSHLSRTEWARLQLARKKLKSTLAIQTNVCLINGHLVLTLSLENNVLLIDSKEKGDVKKIHASLMGFLRLAHLIRLQKHGWSKLLFSATTHHEILNKRILNGHVPYKIWYFIHRARLGLLPTKLFSVSNLCRKCGGKKETMSHALVNCPMMQTLINERHDALEISLVQILSSKFQGTVIRQKTYVNELRPDITMESDTQYYLVEVKCPFDTKMSFELRTQQTTDKYNIIIEILEDVHPGKEVRLVTFIVGTLGSWGPQNSDFLRDLGFSKDEIDQVKTRLMLQNINSSCEQWKRFVQYAPTITPGPIPDAESEDDQGTSDNGPTAATVQGPVIGDEEEELQIYDSGLDESSDDEPDPDDAELLFTIDIEQYLNSVITD

SEQ ID NO: 1423 - protein, 1591 aa, Chrysemys picta
  MOD_RES (6)..(6): Any amino acid
  MOD_RES (16)..(16): Any amino acid
  MOD_RES (23)..(23): Any amino acid
  MOD_RES (25)..(26): Any amino acid
  MOD_RES (34)..(35): Any amino acid
  MOD_RES (37)..(38): Any amino acid
  MOD_RES (40)..(41): Any amino acid
  MOD_RES (54)..(54): Any amino acid
  MOD_RES (59)..(59): Any amino acid
  MOD_RES (68)..(68): Any amino acid
  MOD_RES (72)..(72): Any amino acid
  MOD_RES (76)..(76): Any amino acid
  MOD_RES (78)..(79): Any amino acid
  MOD_RES (81)..(81): Any amino acid
  MOD_RES (90)..(90): Any amino acid
  MOD_RES (93)..(93): Any amino acid
  MOD_RES (108)..(108): Any amino acid
  MOD_RES (111)..(112): Any amino acid
  MOD_RES (125)..(125): Any amino acid
  MOD_RES (178)..(178): Any amino acid
  MOD_RES (241)..(241): Any amino acid
  MOD_RES (243)..(243): Any amino acid
  MOD_RES (279)..(279): Any amino acid
  MOD_RES (311)..(311): Any amino acid
  MOD_RES (324)..(324): Any amino acid
  MOD_RES (364)..(364): Any amino acid
  MOD_RES (366)..(366): Any amino acid
  MOD_RES (408)..(408): Any amino acid
  MOD_RES (478)..(478): Any amino acid
MESPAXIFEKIDAALXIYSAAAXLXXNSLSLSPXXAXXSXXAAPASSTPQKTQXKPIPXTTLGASRKXRTTXKDEXIXXWXKKAPVDTSXGRXSTRRTALRDLTSRSXNIXXALQEEDPRRTPPXSRDQDAERRPAAPEKAATRGAPPTIQDQDADRCPAGRDATGGAPRRPRTRMLXAAPLGRMPPEEPPPTTRDQDADRRPAAPERDAPEGTTSSTPDPETTYHPPVRRRAAPRGTHSXAXDLDAARCPSGQRDIVASESSTPPGATSPPQASLPDXEESPAESAGTTEVRPTEGEAGEDDCIYLQYPXPTGLLLCPFCLPXHGVQTLGALSKHVRKAHNKRIAFRCSRCDAPFETQKKCKXHXATCKGPLTTAKVNPTDTLRVPTPTPTDGPASAPQPASPEPQXVRGDQPPTEGSATPASRTDDATKRTSPASRIPTLDPAVRGITATSQVSDLTRCLSDLIKTIRHNTDTRRXSAPPQVTSCRPAVGATSTAPQAARRDPANGGASRSPQIPRPDPAPGRPNTSSKVTQRDSDRQKPHAPPRTPQPDTTRRRTRTIPSASKHDRAPTKPNTGVSRTPLPPGRSSAASETPRAAPPPPHQDPRLKTHLNTAPQSEGQQGHRLSPQHLNPRRQRSRRNDGREQRVATPWQSAWMEELAKAEDFETFDTLMDRLTAELSAEITARRREPQEASRATRRFPAPTRNNTAREGRRGDVGRRYDPAAASRIQKLYRTNRTKAMREILDGTSSYCAIQPERLYSYFKDVFDHEAQTNLQRPECLLPLPRINLTEDLERDFSPQEVQARLMRTKNTAPGKDGIRYHLLKKRDPGCLVLAAIFTKCKQFHRVPRSWKKSMTVLIHKKGERDDPGNWRPISLCSTIYKLYASCLAARITDWSVCGGAVSSVQKGFMSCEGCYEHNFLLQTAIQEARRSKRQCAVAWLDLTNAFGSIPHHHIFATLGEFGMPETFIQILRDLYKDCTTTIRATDGETDAIPIRRGVKQGCPLSPIIFNLAMEPLIRAISSGPTGFDLHGKKISILAYADDLALVADSSESLQQMLDVTSQAAEWMGLRFNPKKCASLHVDGGARALVRPSRFLIQGEPMASLEEGEVYQHLGTPTGVRVRQTPEDTIAEILRDAAQIDSSLLAPWQKINALNTFLIPRISFVLRGSAVAKVPLNKADSTIRQLVKKWLYLPQRASTDIIYISHRQGGANVPRMGDLCDVAVMTHAFRLLTCPDPTVRSIAQEAVRDVVRKRIARAPSEQDIATYLSGSLEAEFGREGGDLSSLWSRARNASRRLGKRIGCCWKWCEERRELGILVPRIKTPDHTIVTPTARAMLERTLKDAIRCHYAENLKRKPDQGKVFEVSSKWDASNHFLPGGSFTRFADWRFVHRARLNCVPLNGAIRHGNRDKRCRKCGYANETLPHVLCGCKQHSGAWRHRHNAIQNRLVKAIPPSLGKITLDSAIPGTDSRLRPDIVVTDAEKKKVLMVDVTVPFENRSPAFHEARARKALKYTPLAETLRAQGYEVQIHALIVGALGSWDPHNEPVLRACGVGRRYARLMRQLMVSDTIRWSRDIYTEHITGHRQYHTE

SEQ ID NO: 1424 - protein, 1352 aa, Acanthamoeba castellanii
MAAKSVACPHDGCANKYASEASLRRHIKNKHATDEEGDETSHSCPHCHRPFSTARGLSVHIGKSHRQAPPEPTRPPPAPAPADPGLDPDPGPTVTPPSRDDEDREEPDDDPVEIADLSCPHCAQALPSAHGLANHLRACKDHRVPAPGAPRSGPPSSRYWTAVEHHRYVEAMARFADHPDLLARAAAHIGTRTYKQVDSHRTKVIAAEREGRPVRTLDPTMDWRMRPYCASTTARWLAEQGRSPVAPRSPCPEPHAPPPAAALLYIPATPPAPTPRAPVAPPKLAPPAESTVPATPDGNPEAPAPPFSAPGPPTPKALPPPPPSRRNLRPHLVPKDAWQGVADAVAPAASRLLRTPLAHLSTEQWATFEAALAGLEATLHHAARSAEAVPTRCASRAREDAERQLREARKTREIFGKAAALYAAGKDPTATIERIPPEVRLHLPTPGSAEWPARAAAARRVIRRAVARADRLRKRMGILDSDRDLQRLFNANQKKAVRQILAPSTKAPRCQLDPAAVEEAYIQTLAKPPPIDPSPPWKNSVQWPRPPTAADDGGSPFSVAEVRAQLRRLPNGSAPGIDGIPYEAYKRTKLDATLAHVFEVVRLNARLPARWDVARTVLLYKKGDPNDTGNWRPISLQVTIYKIFTAALSKRLISWAGKHNTFSASQKGFLPAEGCHEHAFVLRSVLDDARRHKQNVYLAWYDLRNAFGSVSHDLIAWCAAMLGLPRYLRDAIGAIYRHSALFVQVGDQETTGVIPMRCGVKQGCPLSPLLFNLCVEPALRCLRRTTGYKFYGTSITVEGQAYADDLLTAAPSAYHAARQVATIEEWANWAGVSFVVQALSLDAPAGKCAALAINFEGGLMHSIDPALKVQGAAIPAMSRNNVYRYLGVHVGLTDALGQANELLEKASRDARTICASGLEPWQKVVAIKTFILSRLPFFFHNGKIQRGRCQQFDRELRENLRAALRLPVCTTNAFFHSRVASGGLGILPIAEEQQVYLAAHVFKLLTSPDLSIRAIARHQLAEVTHARHTTPVQDGEASPFFGWLMRGQEVASTTPSGDVSSIWFAAAGAYSRMGWSVRDALHPTLTVGPGVQFEGRFQRANVIPALRASAFSRHAVEWSALRTQGRAAAYQHAVHPATHHWVHNSAGLTTKEYRFAIKCRLGLLPTRAAPHHRNGPTACRACSYARETANHVLGHCPATKAEVIARHNRICRALAQAAEASWTSVLEDVPIPGVDSPLRPDIYCSRPGQCAIIEVAVSYEDAFNASMEGRAKQKTDKYAGLAATVEEQLRLQTRHAAFVVGFSGVVLPASVTATATSLDLPPKTWNVLLKRCVAASIKGSYTAWRRFRRSTP

SEQ ID NO: 1425 - protein, 2004 aa, Acromyrmex echinatior
  MOD_RES (148)..(148): Any amino acid
  MOD_RES (324)..(324): Any amino acid
  MOD_RES (759)..(759): Any amino acid
  MOD_RES (912)..(912): Any amino acid
  MOD_RES (1400)..(1400): Any amino acid
VCSVRGCRREDSRRFYKFKFPLNFVKVPKTIVIGSAFQKSSVSARSQNHSRSTRVPKTRQPRTSNTIGRYTAASANNYLTVIITGNYTVFAQWICYRECTWLLSKFVNFFLTIIGYFFQLRLVVIYEGPVILDTFSNCGSSLFMRGQXSKALLVRLNRSALAMADPQVHYIDYPLPPRVKCVKCFGAEGAGKVKGEYSDPPHLAKHLKKCHPGDTLNYKCSICDLRGTGKYPLRDVKAHYAECHVSPAVDAAGPSTRGSLGECSGAGQPTASRAAKATTRLAETVGGTDKRRAATSGSRQLTLPFAATPSPSTAAGEARAPRSXSTTPTSRSPSYAAVTAGPPSMRSTTTSTTARSKTVAKGAAPNTTTTTTARRSGEAAATRKPPTTATVSKPRVLSVETVRLPVDDIQRAGVQNAAKPARAPSRPPQRTSPEAGGPRTTGAKEKCGEGAYKKLPANSGNPISTRTRRATSVPVEKSEGTARRERVSPHPPPKGIDIILSSTSEEEGTPYQPGGVGRLRLRRKKVTGPPPKMTPREGVVTRARRSTSAPVEKSALDARLTALDRTSSRATGNPTSQIAGGLYTSRGQPERTPPARLPSLSPTTRGSPSGSLGEIRTPISPATSLPATLTTCTVTTTTCGSPITSTGFTGGVGRLITPPSLPQTNILPTIGEEGTSPCVAVVTTHPRPTGEDAPCEAPQPVSDHQRQSIGEPRRDTDTHLACDVATGNAHHLHGDDDHLWKPHNIHGLHRWRGEADNTXEPPPNEHPPDHRGGRNVTVRGGRHHPSLGGRSTSPLILPRPTTPEPERGQEERRLEGAAQPPTTPVVEGDNQWDGQWTVSVRRRARRQQLNDTSPSNSESPPTAGPSRSPRIAPLSALIAASTSRHETSLNLNCTNGNICMDRTPPRNILPVXAERRRETSPQDRVEGDIGYGAGKVSAEHPSAPVNVRGVMSRGRATASSIVPPRANRGEGGRQHHSRRRPDAPVGQPSRDHPAPATVARQRRRERVAARDALLDRAKDVATIADLEAFAASVAAFFGEDASATGAAARARDRSVRSREAGARRGVKGGERPEREGAGRPGSAPADPGASGEARGDWVREAKRLQALYRANRRKAVREVLQGPADQCQVPKRQVQEYFERLYSGGEDLAGAGVEAERPDPSSPREVSAVLGPLAEREVDRRLRRMNNSAPGPDGVSYRDLRGADRGARLLTALYNICLRLEAVPASWKTSNTVLIHKKGDRGMLENWRPLALGDTVPKLFAALLADRLTDWAVTRGKLCSAQKGFLRDEGCYEHNFVLQEVLTHAKRSKRQAVVAWLDLSNAFGSIPHATIRRALIRSAVPRGLIAIWDSMYDGCTTRVRTAEGHTAPIPIRSGVRQGCPLSPIIFNLAIDSVVRVAAEXNDGYSLHGNTWSALAYADDIALLAQTPEGMERMLASVEAEAASVGLRFNPAKCATLHVGAGNGGRVLPTSFQIQGETINPLAQGESYTHLGVPTGFSVDQTPYAAVGDIVSDLRAVDRSLLAPWQKIEMLGTFILSRLDFLLRGARVFKGPLTAVDLNIRRHVKSWLNLPQRASAEGVYMPPRWGGCGLLPLSDLADVLTVAHAYRMLTVRDGAVRELAWESLRGVVGRRIGHAPSCEDIASFLSGSLDGRMRGGGEASLWSSARNAALRQSERLSLRWRWVEATEEMTLECRGPRGAAIKIPPEARGQVVNRLRSAVAEHYASRLLSKPDQGKVFEVSSRSRVSNHFIRGGSFTRFADWRFIHKARLDVLPLNGARRWEANDKRCRRCGEVSETLPHVLCHCGIHSAAIQLRHDAVLHRLWKATRLPGVVRVNQRVEGVSDELGALRPDLVVRHEPSKSVVICDVTVPFENRWTAFEDARARKIAKYSPLAEELQRRGYRVVVTAFVVGALGSWDPRNEAVLRLLRVGNQYAAMMRRLIVSDTIRWSRDIYVEHVSGTRQYLAPSRPSGDLATPPRAVRRRWLAEERSAQDAARRGSDSVSVA

SEQ ID NO: 1426 - protein, 1019 aa, Alligator mississippiensis
  MOD_RES (52)..(52): Any amino acid
  MOD_RES (652)..(652): Any amino acid
CHHAGLRPGTPNRTRRPDQTAPLPDPRGHPMPPNRRGSRSRPEEPSRREPPXPRACQGLRVWSPPQQRMPTPWQTLWLEELSRATTFKAFEASVARLTEELSAAARPGQPRGGNNRPATRRDHRLQPQRRPRRQRYDPAAASRIQKLYRANRPKAVREILEGPSAFCQVPRETLFNYFSRVFNPPAEAAAPRPATVEALTPVPPAEGFEDAFTPQEVEARLKRTRDTAPGRDGIRYSLLKKRDPGCLVLSVLFNRCREFRRTPTTWKRAMTVLIHKKGDPTDPGNWRPIALCSTVAKLYASCLAARITDWAVTGGAVSRSQKGFMSTEGCYEHNFTLQMALDNARRTRKQCAVAWLDISNAFGSVPHRHIFGTLRELGLPDGVIDLVRELYHGCTTTVRATDGETAEIPIRSGVRQGCPLSPIIFNLAMEPLLRAVAGGPGGLDLYGQKLSVLAYADDLVLLAPDATQLQQMLDVTSEAARWMGLRFNVAKCASLHIDGRQKSRVLDSTLTIQGQAMRHLRDGEAYCHLGTPTGHRAKQTPEETINGIVQDAHKLDSSLLAPWQKIDAVNTFLIPRVAFVLRGSAVPKTPLKKADAEIRRLLKKWLHLPLRASNEVLHIPYRQGGANVPRMGDLCDIAVVTHAFRLLTCPDXTVSIIAASALEETARKRIGRQPTRRDLATFLSGSLEGEFSRDGGDFASLWSRARNATRRLGKRIGCAWTWTEERRELGVSLQPAPHADRVTVTPRTRTFLERFLKDAVRNKYAGDLRAKPDQGKVFDVTSKWDSSNHFMPSGSFTRFADWRFLHRARLNCLPLNGAVRFGHRDKRCRRCGYVAETLPHVLCSCKPHARAWQLCHNAVQDRLVRAIPAAAGEISVNRTVPGCESQMRPDIVITNEEAKKVVIVDVTIPFENRRQAFTDARARKREKYAPLADILRGRGYDVTVDALIVGTLGAWDPSNESVLHACRVSRRYAKLMRCLMVSDTIRWSRDIYVEHITGHRQYTDPTRRTAAGPDPEGTA

SEQ ID NO: 1427 - protein, 1584 aa, Chelonia mydas
  MOD_RES (117)..(118): Any amino acid
  MOD_RES (121)..(121): Any amino acid
  MOD_RES (139)..(139): Any amino acid
  MOD_RES (141)..(141): Any amino acid
  MOD_RES (278)..(278): Any amino acid
  MOD_RES (328)..(328): Any amino acid
  MOD_RES (409)..(409): Any amino acid
  MOD_RES (490)..(490): Any amino acid
  MOD_RES (529)..(529): Any amino acid
  MOD_RES (688)..(688): Any amino acid
MTTKKVLGASTTLQTSSTKGKNSGCSKDPLRDAVPGRSWILRPACRDITTRRNIPPAPQQQQPPMESPPTLQLQDALRRPSPTPAAAQVADAGGALAALHTIKRGISVDWTSISPKXXQRXTSASPDACPASETTQRDXRXLLDARPAGPLDPTRPHQDEPASDTADAAGTPLLQGNEDTIYLQYPLAADMLICPICSPPQSFHLLGVVTRHLKRCHSKRVAFSCALCSLPFETQKQCKMHQVACRKCLKGTTQSPAPAPSPPAARRPAAPEPQRRKXTSQAAVKKPAPVARPAERDAAIEKVPAASGNITQVLASRRPVSPSHVAKXISMLRRLSAASPPVQHVPVPRRISAPPRIAARDPVAGRASAAPQTALRTPAAGGASTTPQTALRTPTAGGASAMPQTTLPXPRRPDWRNQPRSHSKAPGLHRQTDQHGPQVHSAGHCLREISRSSSNRLGSSHSAAATHRRTGGVPATPEPDRVSPTTSNAXIPPEIPPQHPTEGNPDPRDRRQADHTAGSEPAPDEVEDXEGQRPMVRAATPWQTAWTEELQAAASFDDFDLLVDRLTRELSAEIAPRRSSNQENAPPAHRTPAPNHNTTTRGARSRDASRRYDPAAASRIQKLYRANRSKAMREILDGPSPYCTIPSERLYSYFKDVFDRIARNDAQRPECLRPLPRVDEAGVLETDXTPKEVMARLSKTKNTAPGKDGIPYSLLKKRDPGCLVLATLFNQCKRFCRTPSSWKKAMTVLVYKKGERDDPSNWRPISLCSTMYKLYASCLASRITEWSVSGGAISSIQKGFMSCEGCYEHNFVLQTTIETARRARRQCAVAWLDLANAFGSMPHHHIFATLQEFGMPENFLRVIREVYEGCSTTIRSVEGETAEIPIRSGVKQGCPLSPIIFNLAMEPLLRAISNGTDGFNLHGERVSVLAYADDLVLTADDPESLQGMLDATSRAADWMGLRFNAKKCATLHIDGSKRDSVQTTGFQIQGEPVIPLAEGQAYQHLGTPTGFRVRQTPEDTIQEILQDAAKIDASLLAPWQKINALNTFLIPRISFVLRGSAVAKVPLNKADKIVRQLVKKWLFLPQRASNELVYIAHRHGGANVPRMGDLCDIAVITHAFRLLTCPDAMVRNIAANALHDATKKRIGRAPSNQDIATFLSGSLDGEFGRDGRDIASLWSRARNATRRLGKRIGCRWEWCEERQELGVLVPQIRSNDNTIVTPSARGMLERTLKAAIHSLYVETLKRKPDQGKAFELTSKWDASQPLPRRGRLHPFRRLAVHPPCPAQLRPAQRSRPPREPRQALQEVRLLQRDPAPRPVQLQAPLQSLAAAPQCHPEPPGESHRTAPGGGRRELRHPRYPASGTPANHFLAGGGFTRFADWRFIHRARLNCVPLNGAVRHGNRDKRCRKCGYSNETLPHVLCSCKPHSRAWQLRHNAIQNRLVKAIAPRLGEVAVNCAIPGTDSQLRPDVVVTDEAQKKIILVDVTVSFENRTPAFREARARKLEKYAPLADTLRAKGYEVQMDALIVGALGAWDPCNERVLRTCGIGRRYARLMRRLMVSDTIRWSRDIYIEHITGHRQYQEV

SEQ ID NO: 1428 - protein, 1420 aa, Chrysemys picta
  MOD_RES (694)..(694): Any amino acid
MTQDQDADCCPAGKDATRGAPPMTQDQDADRCPAAPERDAPEGTTSSTPDPKTTYHPAVRRRAARRGMHLRAQDLDAARCPSGQRDNVASESSAPPRATSPPQASLPDPEESPGESAGTTEIRPTEGEAGEEDRIYLQYPLPTGLLLCPFCLPVHGVQTLAALSKHVRKTYNKRIAFRCSRCDLPFETQKKCKFHQATCRGPPTTAKVNPTDILRVPTLTPTDDLASAPQPASPESQQIRGDQPPTEGSVTPASRTDDATKRTSPVSRIPTLDPAVRGTTATSQVNNLTRRLSDLIKTIRHNTDTRRCSAPPQVTSCRPAVGATSIVPQAARRDPANGGASRSPQIPQPDPAPGRPNTSSKVTQRASDRQKPHAPPRTHQPDAARRRTRTIPSASKHDRAPTKPSTGASRTPLPPGRSSAASETPRAALPTTPGPPPQDPPEHRSTVRGTTRPQTVPAAPEPAETTQQEERRPRARVATPWQSAWMEELAKAEDFENFDTLMDRLTAELSAEITARRREPQEAARATRRFPAPSRNNTAREGRRGDVGRRYDPAAASRIQKLYRMNRTKAMREILDGTSSYCAIQPERLYSYFKDVFDHEAQTNLRRPECLSPLPRIDLTEDLERDFSPQEVQARLSRTKNTAPGKDGIRYPLLKKRDPGCLVLAAIFNKCKQFHRVPRSWKKSMTVLIHKKGXRDDPGNWRPISLCSTIYKLYASCLAARITDWSVCGGAVSSVQKGFMSCEGCYEHNFLLQTAIQEARRSKRQCAVAWLDLTNAFGSIPHHHIFATLGEFGMPETFIQILRDLYKDCTTTIRATDGETDAIPIRRGVKQGCPLSPIIFNLAMEPLIRAISSGPTGFDLHGKKLSILAYADDLVLTADDPESLQGMLDATSRATDWMGLRFNAKKCATLHIDGSKRDSVQTTGFQIQGEPVIPLAEGQAYQHLGTPTGFRVRQTPEDTIQEILQDAAKIDASLLAPWQKINALNTFLIPRISFTLRGSAVAKVPLNKADKIIRKLVKKWLFLPQRASNELVYIAHRHGGANVPRMGDLCDVAVITHAFRLLTCPDATVRNIAANALRDATEKRIGRAPSNQDIATFLSGSLDGEFGRDGRDIASLWSRTRNATRRLGKRIGCRWEWCEERQELGIRVPQIRSDDNTIVTPTARGLLERTLKAAIRSLYVETLKRKPDQGKAFELTSKWDASNHFLDGGGFTRFADWRFIHRARLNCVPLNGAVRHGNRDKRCRKCGYPNETLPHVLCSCKPHSRAWQLRHNAIQNRLVKAIAPRLGEISVNCTIAGTDSQLRPDVVVTDEAQKKIILVDVTVSFENRTPAFREARARKLEKYAPLADTLRAKGYEVQMDALIVGALGAWDPCNERVLRTCGIGRRYARLMRRLMVSDAIRWSRDIYIEHITGHRQYQEA

SEQ ID NO: 1429 - protein, 1081 aa, Drosophila yakuba
YAPGYEAAQSPCGREPPRDHHRRPRDACGSSHSPEPCLTTPRLLPETVSAEPCDDESQRTRYASPHKQARTLHDAEPRDASREHAPSCAEPRCHRCQWTHWKDCCPHSTNTTDGPEGTDRCADTITSPATAACPQRSPCPLGSSNGCDETAPEKRQPAADLVHTAPFAVLVRAGPFADLVRAGPFADHHQDDDPLPHRSGSLGPLCSKQKDPRKTHQHRHSGQAGNQTHTDIPRAAPSRRAAICLMANAAATREDLLRAATSLSEMAAANQPTRSPTGGGEPTSQGRRGPQALADAAKRIQQIYRTNIPRAMRKVLRTLLTAVFSACLRTGHVPDLCKKSRTVLIHKKGDRTDLSNWRPLSMGDTIPKLFAAVMADRLTAFLTNGGRLSEEQKGFLQHEGCHEHNFVLGQVLEESRRQGKDLVMGWLDLSNAFGSIPHATIMDAVAGMGIPSRIRTIIHQLATGAATTAKTIDGMSEEIPIEAGVRQGCPASPILFNIAIERVLRKIKTVNAGYLLYGSRISPLAYADDLVLIASSPEEMRSLLRAADDAAIEAGLHFNPKKCATLHLTGKKSSRRAVQTGFLVRGTPIPAMTEGDAYEYLGIPLGLKKNQTPRAAMEAIVGDIAKIDDSLLAPWQKIDAARTFVAPKLDFVLRSGATLRAPLRHLDTVIKKHIKKWLYLPQRASAEVVYTPLKKGGAGILPSSILADVLTIAQAHRMVSCPGEVVSRIASEGLREAVKRKINREPSGDEMAHFLSGSTLSGETASFGDAGFWSRVRMATKRQAVHLGVRWAWRGGELLVESRGQRNRPVATDSNSRSQLIQRLRCAAQDEFLTILINKPDQGKVAKLSTLTPVSNAFIRDGSFTRFADWRFIHRARLGVLPLNGAIRWGSGDKRCRVCGYQLESVPHVLCHCMHHSNAMQQRHNAVMDRLAKAGSRLGTPRVNCRVEGVAEDMAALRPDLVWRDERSRKIVIVDVTVPFENGAEAFDNARGEKEEKYRPLAEALRAMGYQVKLEAFIVGALGSWDPKNERVLKTLGVSRFYAGLMRRLMVADTIRWSRDIYVEHVSGIRQFTLPSGAPSN

SEQ ID NO: 1430 - protein, 1258 aa, Gavialis gangeticus
MSGPRQAAADPRPSTDPRRQRDSQSPEPRLTRAASRRRTPDPEDAPRTTAEHPERRRTPPDPRGPSATTAGPERRRPPDPGGPEDDPPEGLPTLVEEPRTPPTPDPPDGRPRRGCRRGSAHVPPLPPPCEAAVPDLPPAKAVQVAQRHEQTPTALPPAAPSVLLLPLRHRVRGPEAPEEPPQGMPGPRGREETRHAGEVRRPTTRAAARRPARPAAPPATPPDQTSGDRPTERPAPATPPRRSAPRDPRPDVTPRPDGPPPGPPGPPDAPDPPRIPEPPGEPEPPGALQLPSVPGSPGAETSAQQRMPTPRQALWLEELSRATAFEAFEASVARLTEELSAAARPGQPRRGADNGPTTRRDHRPQPQRRPRRQRYDPAAASRIQKLYRANRPKAAREILEGPSAFCQVPRETLFNYFSRVFNPPAEAAAPRPATVEALTPVPPAEGFEEAFTPREVEARLKRTRDTAPGRDGIRYGLLKKRDPGCLVLSVLFNRCREFRRTPAAWKRAMTVLIHKKGDPTDPGNWRPIALCSTVAKLYASCLAARITDWAVTGGAVSRSQKGFMSTEGCYEHNFTLQMALDNARRTRKQCAVAWLDISNAFGSVPHRRIFGTLRELGLPDGVIDLVRELYHGCTTTVRATDGETAEIPIRSGVRQGCPLSPIIFNLAMEPLLRAVAGGPGGLDLYGQKLSVLAYADDLVLLAPDATQLQQMLDVTSEAARWMGLRFNVAKCASLHIDGRQKSRVLDSTLTIQGQAMRHLRDGEAYCHLGTPTGHRAKQTPEETINGIVQDAHKLDSSLLAPWQKIDAANTFLIPRVAFVLRGSAVPKTPLKKADAEIRRLLKKWLHLPLRASNEVLHIPYRQGGANVPRMGDLCDIAVVTHAFRLLTCPDATVSIIAASALEETARKRIARQPTGRDLATFLSGSLEGEFGRDGGDFASLWSRARNATRRLGKRIGCAWTWTEECRELGVSLQPAPHADRVTVTPRTRTFLERFLKDAVRNKYAGDLRAKPDQGKVFDVTSKWDASNHFMPSGSFTRFADWRFLHRARLNCLPLNGAVRFGHRDKRCRRCGYAAETLPHVLCSCKPHARAWQLRHNAVQDRLVRAIPAAAGEISVNRTVPGCESQMRPDIVITNEEAKKVVIVDVTIPFENRRQAFTDARARKREKYAPLADTLRGRGYDVTVDALIVGTLGAWDPSNESVLRACRVSRRYAKLMRCLMVSDTIRWSRDIYVEHITGHRQYSDPTRRAAAGPDPEGTA

SEQ ID NO: 1431 - protein, 1241 aa, Lytechinus variegatus
MSCPREGSDHLGPDPETPALHQGSDIRVTSSRLRGSRGKSSRQPSSRHQVPASEASATAQQTAANECQVCGSSFATSSGLRRHMARLHRAASADPEGAAPASITEIFDYPLPSRWKCSACSENFFNQQTLKRHQTRHHPATTFAYAFRCSSCRSEFDSARRAANHWQVHKKERSQLSGTEPQASSQARVSMAHSPPPLPNTSWAELASNPAEIPSFVWESPPKNRPSVEEFGSSLPTDVTMMSQSPPPQVQSSPVPALTPLSPAATASSSPPGAARQLTPPTQTNTPVTQRARLQPEADVVPELPPSVTEHPVSDAQHWVDAVSSASDWSEFEAVCDQFVIHAVAVSRPNLARPQQQDRQRSGDHPPRQQRGQHRPTFDVREASRIQKLYRTSKKRAIRHILKEKSPSFSGSESDVLDFFREVYSAKEVDEEAVGKLASSLFDVPQGDDSATSLSLPTSAKEIGARLSRMTNSAPGKDRLEYRHIRRADGSFSISEAIFNKCLAEGRIPAPWKTASTILLHKAGPTDDPANFRPIALQSCLYKLFMAVLADRLTKWACENQYLSPEQKSARPCEGCFEHSFLLSAALKDCRRNQKTICIGWLDLRNAFGSIPHPVIKIVLSSLGVPDSLVTLLMDAYNGASTSFTLTGGQTDTVPIRSGVKQGCPMSPILFNLAIELIIRAVKKNASDNHLGVTVQGKNLSILAYADDLVLLSRDTEGLQSLLQVAGSSASTLQMQFKPQKCATLTLDCKRGTNVRQSAHHIQGAAIPSLTEEERYRYLGVPIGLPRLTSLQESSRKLSSDIETISSSLLAPWQKLDAIKTFVIPILQYTLRATEYLKSDLKPLRAAIIKHVKKICHLPVRSSNAFVFASRPSGGLAFVDPGVDADILVVTQAVRTLASDDDTVRAVALGQLTSVVHRTVHSAPSDDCIDKFLSGSSEGPLANSGNSGQASSLWSRTRAASRRLKIRIVGASSGDIKVESGGRAIPSKKVTAGLRSDHHNEMSEKLRSLPDQGKVARALSLDSFANATSWLTSGSFIRFCDWRFIHRARLNCLPTNAAVRRWKQNANTKCRRCDHQLETLPHIINNCRPNMVPIRRRHNSIQERLVKAIHYGDIYQDQHVPGDPNPRERPDITVVEGNKVTIVDITIPFDNGPDALSTAANAKVMKYDTLRQELASRGMDVEVHAFVIGSLGSWHGDNERVLGRLGISRRYRTLMRRLCCIDAIKGSRDIYIEHVTGHRQY

SEQ ID NO: 1432 - protein, 1203 aa, Nasonia vitripennis
  MOD_RES (3)..(3): Any amino acid
  MOD_RES (213)..(213): Any amino acid
  MOD_RES (235)..(235): Any amino acid
  MOD_RES (271)..(271): Any amino acid
  MOD_RES (328)..(328): Any amino acid
  MOD_RES (347)..(347): Any amino acid
  MOD_RES (372)..(372): Any amino acid
  MOD_RES (451)..(451): Any amino acid
  MOD_RES (463)..(463): Any amino acid
  MOD_RES (770)..(770): Any amino acid
SGXTGREVKCITVNVLMEQQPHTKAIREGDFIVILLPQSDDETLCCPLCVGRGRYSGKTRVECLNRHVKEVHPDLTTTFRCWGCGFAAPGDKKYPRKIVTQHCATCVPEVSSAPSGRVDGERRVNTRRRLGIAAATEASPVRRTRRNGLASPPVEQNISQSAAPPEPARVPQHPEIVALGESADDEVFRSPVNSPPRDWRAAAPQQAASSSPXAVPGITAATPSNTTRTGNGSAXSILAEHPIPAPPPTNTTEANGRADIPRSGRAPPPGXQAARRRAPTTEQRRIVGLLEAATGREQLEEATTQAMLFLARLTGRRPEPRNAIRPGXRQRHPAQGDVQAQAPDRIXEAKKLQRLYRTSKKRAVQKILAGPXMNCQIDKNTITAHFVELAARRDGGEDWPDVFDREEPTAASGEALCTPITREEVFRRLKGRNNTSPGPDGITYRDLAKAXPGAHVLAALYNXIWRIEATPALWGVSNTTLIYKKGDAMDISNWRPISLGDTVPKLFAAILADRIKRWAVANGRYSASQKGFLEFEGCYEHNFVLQEAIREAKGGRKELVVAWLDLASAFTSVPHSSILQALEGHGLPSKARNIISSLYTGMTTRFHTAEGPTDPILIQSGVRQGCPLSPDVFNLTLEVVLREIQRTGEGYTIEGRRISHLAYADDVAILADSPAGMRRLLFAAERGARAVGLTFNPAKCATLHIAGRGEEAVRPTEFSVQGTPVRALASGEAYEHLGIPTGYQVRQTPINTLRDLLADIGSIDRSLLAXWQKLDAVGTFLLPRLDFTMQGAHIDKGFLTEADKIIKKAAKSWLSLPQRASAELVFLPPSQGGGGLLTVAHSYKMLYSSDVTVSTIAGSTLRRTVSERLKKRASNIDIARFLSGDLDLPRSTSPSTFWTKVRSAALRIKTKLGLRWSWCQGGEVLLMACGDPRAPGTRVSPQTKHLVTTSLRRCLNRHYAESLLAKKDQGKVFEVTRRSGQSNHFLRSGSFTRFCDWRFIHRARLDVLPLNAAKRWQRGMDKRCRRCGSDLETLPHVLSHCGPHSAARQKRHNNIQDRLVKAASRCPGTISVNQTVVGVRGPDAALRPDIVVRDDVNRRVTIVDVAVPFENRLEAFDGVREAKIAKYTPLARQLTDSGYTVTVEAFVVGALGAWDPRNERVLSLLSISRYYAILMRRLMVSDTIRWSRDIYVEHVSGIRQYRE

SEQ ID NO: 1433 - protein, 1458 aa, Phytophthora capsici
MVVSRITARLEATPAPRWDPPLPRRVIASRIADRLVPATAPCRSALNAAFPSPSRDTVTESFTQEDRQLEPLTRHVDEETKDSELPGRAPTVLDEESKDNDATAGEWLLRFDGACRANPGPGGAGAVLFNPSGAASWTCSHFMPGATETNNTAEYTAFLLGARAAADHGATLLRVQGDSQLVLRQVKGIYGAKSTRLRRLRDAVRAELARVGQFSLHHIDRQDNAHADRLANRALDMKSTLVECATHPGRNACTTTLTTSAAAESPASPPPVGARDTPMADAGEERLADVDDGEVYAAMRLGPGEVPERRPRLRLRQLSDEELEAASEMVERLGAALSAKITDAEDWASAEGYITALPYMLYDKLQSYSQAPRGPQQPVLTRSPRGDDRPASSEPNASSTTGGVASEHQPRRRRRRGRRKGRRQRRNPRRSGREGATGGHQQHKKHKPRPPRETQHHREHRLDEALDELHALERTDPHNRPAIAKARRRVGRIRSAINQQLLRHKFDTDEKACVDGILSTARAERAARAATPSPPASGAPTTTVSAPGAIVTNDDGTCPIPSDKLWRHFDAVNTPRLDFDAEAPGSAAFRAAMDHLPAATRLLDLLKEAPSTDEIETQLQHVKASSSPGLDGVGYDVYKRFTIQLLPVLRAAFRCCWLYKKVPQSWKLGVVRLLHKKGPREDPANWRPICLQQAIYKLYTGILARRLTRWMDANDRHAPGQKGFRAVNGCGEHNFLAATLIDNARRKHRPLYEVWYDFRNAFGSVPFALLWDSLQRLGVPPDYVDMCKGLYNQASFVVGNAVDGSTAPVEQRVGVFQGCPLSPQLFNAAISPLLYALRRLPDTGVQLSSVDRPGASAYADDLKIFSGTKAGITQQHELVATFLRWTGMQANPAKCRSMGVRRNTNGAVEADNVHLELDDTPIPSMTHMQSYTYLGIGDGFDHVRRRVELAPKLKTLKHDVTALVESGLAPWQVVKAVKVYLYPRVEYALRHLRPDDQHLESFDLHLRRGLRHLLRLPKNATNEFFYAPVSRGGLGLLPLVELHAALQIAHGWQTLHSPDPAIRRVAREQLYQIADARHRLDKDHWPHRREELCELLLNGELGTSAHAPPKRRNGDIGSLWVDVRKNLKTFGLKVATAPANQETGVPAQPLQLRVPHHAEWLDHGNVLRHVKLHIKNLHWQTWCALSDQGKTARVHGGVGSAFLTRPRGMWESDYRFAVAARLNVVDTVNTLSRRRLRAHDRCRYPACRWKETLAHVLNHCPGTMDAVRGRHDDALKEIEHTLRASSGDRRELRVNQTVPGLPGPPLRPDIQVYNHDKRTVAVVDLAVAFDEQPSEDPESSGLAKAVQIKKAKYAGIKEHLENQGWKVHLSAIVYGSLGSVAASNHKVYTEHLGLLKRDAKRLDRQLSSACIQSSRRIWNFHCAKHRARQHEHQAPPSQATRGRRVTETGGNPSRTDRR

SEQ ID NO: 1434 - protein, 1704 aa, Phytophthora infestans
MLADPAALAAGLARAPPPPSAPQDPSPAFPAGPAGQNPRAAAPARVEVHTVVAPPGRAGGMLPDPGLVEEPIQATYAHDAAQFECALCPYVAESMAVLVQHRRSAHRGTRFKDIFTSGCQCSLVFYARIVAASHAVACARRNQRAVPPAPTPVAPTRPEATPQPTGYLAAAMTAAAAAASSDTVVAAATNMQSAVPAAAKTTGLQLVPPELEPALPQRASCHAGKRRRLNADEAVTPCTPTARVSPQTEVAMAPHDAPQDDTVLQREAAEPQPDPAATPGAQVQRVEDTTAAQDDTVQQDHDADTAQVSPPRRTPTRWGPRPSSTQEPSPMTGEPAATLAARRPLTPAATGTRATRWGPCHRAIGAAAIARLVTGLSTEPAQPQRRQPPPPQEPPSQPEPLAAAATAAADIAATVAADIAAAAANAAMDVDGGPAADETWLLRFDGACRRNPGPGGAGAALFAPSGAVVWTCSHYMPSRSETNNTAEYTALLLGVQSAVHHGASHLEVEGDSSLVIAQVKGTFACRNARLRQLRNRVRHALRSVDTHKLRHIDRQANAHADRLANRALDQRRTSSECGTHGSCMDSCLAVPTALAAQETPPAAPPSTSATPAEGNAMDDIAAEIAARDEGETFPVLPIGPGSAPERQPRLRLRQLSDEERDAAADALQELADTMASKIEDADSWTSGEGYISSIPERIREVLQPYATAPPQPGRSRRQQRRRPPRVTRNQREHRLDEALDDMAATQQATPRDQRAVRRARRRVGRVRASMAQQELRHEFAKDESKCVAKILKTASTETAAEDEHPETCPIDAATLHAHFTGVNAPRTDFDYDATSGREFRAAMSDLPPATVEIDAFDAELTIDEVEDQLTRAAKTSSPGHDGIDYGIYSRFAAQLVPLLHAVFQFCWRHRRVPRLWKVGIVRLIHKKGDPRQPTNWRPICLQPTIYKLYSGLLAHRLSRWLEGNDRLPMAQKGFRAFNGCHEHNFMATTLLDQTRRQHRKLYQVWYDLRNAFGSLPQQLMWRVLRHLGVDSGFIDRCRDIYRDSAFVVANAADGATDPVRQEVGVYQGCPLSPLLFVAALVPLVRRLEKLDGVGVPLADGVRPCTTAYADDLKVFSDSAAGIRKCHDTVAGFLAWTGLRANPGKCASLAVTTNARGNPTRDSSMRLEVHDAAITTLSLHESYRYLGVGDGYDHVRHRLQLEPKLKQLKREAVALLTSGLAPWQVVRALKVYVYPKVEYALRHLRPLQSQLQAFDRVVSKGLRHLLSLPRSATSEVLYAPTSSGGLGLQPLVELHRALQLAHAWQMLHSKDPAIQAVARAQACQVVRKRYRLQEDHWRGRDDELVRSFLNSELAASPHAEVLRRNGDIASLWSDVQRWLRIYHLRFEHCDETEAHGPLSFRVPHHNKWLTHKTVLRHVKLHLKIRHQTRWKGMVDQGKTVRVHGGVGAKFMTTGAGLSDDDYRFGVKGRLNQVDTNSVLKRKRLRAHTTCRDPTCSSAETLAHVLNHCESNMDAIRQRHDDALEQIGSKIRGALDRAKSPTELRLNQTVPEYTGAALRPDIVLRNVAAKTMVIADLAVTFEDQAARARHSSLQLSHDHKTLKYQPIVAELQHKGWRVQTAAIVYGTLGSVQPSNFKAYTEKFKLHKREARQLDLQLSSHCIRASHRIWGWHCRQHRDRQRSGTASRASRGSGGAPRRTSQAPARR

SEQ ID NO: 1435 - protein, 1432 aa, Patiria miniata
MCLKSFSSTSGLRRHMARLHRQPSPDASTPSTMTEVFPYPLPKVWPCVVCRENFYHNQTLKRHQKNFHPNVDLTTVYQCSVCGQEFVTGRKASFHFKVHRRMSASAIPTPSAMPSSPMDLIRGLVGEPLPPSPARTPPPLARYISPAPRSSFSPPWNPSPPPRSPTPLPRPLTPPPRSPSPPPRSPTPPPPVTLTTAPVTEPAVPVALTTAQVTEPSAPAVHTAAPVTLSNAPVTEPATPATDPATPVTRLHSPVTHISCSISFTASHAPYSCAAPTSPSVYACSPRRRQCSSTIAAVCNSEASSGNPCLLALPVHRHHLPDTSPQRPGLLFHHPGIPPHRPGRPPHCHGHSLHRHDHRARRPGRQHHLPRSPSPPPRSPSPPSRSPSPPPRSPSPPPRPSTPPPRSPSPTPRSPSPPPRPPILPPRSPDSTHRSLTSHARSPSRPATPPIPVQPRHLRPSTPAHPGVDNAVPPSQQSAIDVWLAELSRSADFESFEDVCDRFVEFAAAEGRNNGRPARPAHQPPRDRGNQGPRPQRPPRPHRPGLGPEFDAQEASRLQKLYRTSKKRAIRTILTGSDVRYSGYRGPHPALMSDTAATEVLTSGFLSLEVFSAREVDTDTIATDTSLLFPNSAQARESGQDLLRPVTQREVSLRLGRMSNSAPGKDRLEYRHIRQVDGAFRVTLEIFNRCLRESRVPSSWKTATTVLIHKKGDATDPANFRPIALQSCLYKLLMAILSDRVTTWALDNDLISSSQKSARPGEGCYEHTFLLSTVVKDARRNQKNMYAAWLDLQNAFGSIPHDAMFTVLTSIGAPEGLVSLVRDVYTDASTDFVTPTGRTAAVPIHSGVKQGCPISPVLFNLTLELIIRAVNASATRDRSAPVVHGQAVPILAYADDLVILSRSSDGLQSLLTTASIMATKIQLKFKPAKCASLSLECRRGTKVRPLEFNVQDKIIPALTEEQHYRYLGVPIGLYRTDDSLETLVAKMTDDIQRIDSSLLAPWQKLDAIRTFVQPCLAYTLRAGDCAKKHLKRLRGQLVKTARKVCNLPTRATTNYIFADRRAGGLGFIDPNVDADIQIITQAVRMLSSPDDITRAIATGQLSSVVHRTIHRAPTQEETDEFLSASMEGDFANSGNSGQASSLWSRARAAARRLKVTISGSLSGSVITKSTENREMAAKSITTALRAQSRAHYTHRLLSLPDQGKVGQSLNQDQYMNSSSWMSSGSYILFCDWRFIHRARLNTLPTNATAQRWKPNTSPACRRCQHPQETLPHILNHCPPNMVPIRRRHNLVQQRIVSAVRHGRVFVDQHVPEDPNPRERPDITVVEGDKVTIIDVCCPFDNGRDALMTAAAAKETKYADLKQALVAAGKDVEVFGFAVGSLGSWLPSNERALRRLGIAKRFRTLMRKLLRIDAIKGSRDVYIEHMCGHRQYT

SEQ ID NO: 1436 - protein, 1216 aa, Phytophthora sojae
MDVDGGPAMPEPWVLRFDGACRRNPGPGGAGAALFKPCGTVAWTCSHYMPNSSETNNTAEYTALLLGVQSAVHHGASHLEIEGDSHLVVAQVKGTFACRNPRLRQLRNRVRHALRAVTSLTLKHIDRKANAHADRLANRALDLKRSLAECGEHQGAMESCLHMNPAAQRQREQPAPPARPACAPTRAESASDHDEDIDAEIAARDGGEAFPTLPIGPGTAPARQPRLRLRQLTEDEQEAAASALQAMAEELACKIEDADSWTSGDGYISAIPSRIRQLLQPFTAAQPHPRPPLQQQRQRPPRVTRTQREHRLDEALDEMAAVQQERPTSRSAVRRARRRVGRIRASMRQQQLRHDFARNESKCVEDILRAASAETAAEEHPETCPIDSGTLHEHFTAVNSPRINFLPDEACGALFREAMADVGTPQERRSALTDELTMDEVEDQLMQAATNSSPGHDGVGYDIYKKFAAQLVPLLHAAFQSCWRHHRVPALWKVGFVRLIHKKGDPNDPANWRPICLQTAIYKLYSGLLARRLSAYLEANGLLLMAQKGFRAYNGCHEHNFVATTLLDQTRRMRRRLYQVWYDLRNAFGSVHQDMLWYVLRLLGVERAFVERCDDIYEDSYFVVGNAADGATEPVRQEVGVYQGCPLSPLLFIAALVPLLRALEKLDGVGVALADGVRPCTTAYADDLKVFSDSAAGITRCHAVVEKFLEWTVLQANPGKCAFLAVTRNARGNPAHDKDMKLSLHDEEVSSIKLHDSYRYLGVGDGFDHVRHRLQLEPKLQQIKREAVALMQSGLAPWQVVKALKTYVYPKVEYALRHLRPLQSQLQGFDRVVAKGLRHLLRLPRSATNEVLYAPTSSGGLGLQPLVEMHRALQIAHAWQMLHSKDPAIREVARAQVWQVARKRHRLREEHWRERDDELVRCFLNSELAASPHAEALRRHGDIGSLWSDVQRWLRIYHLSLVVQDDRNGLDPLGLRVPHHAKWLDHKSVLRHVKLHLKIRHQTRWKGLADQGKTVRAHGGVGAKFMSTWAGLSDDDYRFGVKARLNQIDTNAVLKRKRLRSHKTCRDPTCSSAETLAHVLNHCESNMDAIRQRHDDALEQIGSKIRNALKRGKSTAELRLNQTVPEYTGAALRPDIVLRIVAAKKMVIADLAVTFEEHAAGARHSSLQLSHDHKTLKYQPIVAELQLKGWQVQTAAIVYGSLGSVQPSNSTPTRKS

SEQ ID NO: 1437 - protein, 1417 aa, Pythium ultimum
MGTQSARERGAPSAPHSHTLGPRTPPRPPACSKHGELESAAGGRDGQCSDGAERERDAERDIRANERDCNGDGDGDDADSDSDDRNDARRRSRRPRATATTTTSAPTTTTTTTTSATTSATTPATDSSPWVLRFDGACRRNPGPGGAGAALFEPGGAVVWTVSHYLPGSETNNTAEYSAMLLGVRSAIHHGATRLRVEGDSHLALSQVRGTFACTNRRLRKLRNRVQAALRELGDYRLVHIDRQANAHADRLANRALDLRKTKVDCGPHATTTDACVQPAEILAPTARLSSSSSSSSSSSSDEPMPGLEEPAADDETDADAEADIAMRDGGEIFPTLQIGPGSAPAQQPRLRLRQLSDDESEAAARTLEHFANDMASKIADADDWRSGEGYISAIPVRLRELLAPYAVPIRSPPRNASSRPPRPQSRPPRPPRVTRHQREHRLDEALDDLAAAQRSTSTDQRSIRNARRRVGRIRTAQAQSDLRSQFATNERACVESILRAAKPDGTEPQASAGTCPIDRATLHAHFAGVNTPRERFDFDDALGADFRAALDVLPPPDQAADAFADELSLGEVEDQLDRVVASSSPGLDGVGYDVFKRFRLQLLPLLHAAYQCCWRHRRVPATWKVGLVRLLHKKGDRAEPNNWRPICLQQAIYKVYSGLLARRLSRWLEANERFTTAQKGFREFNGCHEHNFVASSLLDQTRRLHRKLYAVWYDLRNAFGSMPQPLMWRVLARLGVDTAFLQRCEDIYADSFFVVGNAADGATDPVRQEVGVYQGCPLSPLLFISALIPLLRALQRLPGVGVPLADGVRPCTTAYADDLKVFSDSAAGIQQCHGTVARFLRWTGLRANASKCALLPVTTTARGNPAIDDTLQLELHGDAIARLTLQSSYAYLGVGDGFDHVQHRVQLAPKLAELKRDAVALLRSGLAPWQVLKAIKVYLYPRIEYALRHLRPLQSQLEGFDRAVAKGFRHLLRLPANATNELLYAPVSSGGLGLLPLVELHKALQIAHGWQMLHSKDAAVQAIARAQVRQVVQKRYTLDADHWQGRDDELVQLFLNSELAASPHATIKRRNGDIGSLWSDVQRHLKTLQLRLETREPTADAPDSPNGLLHLRVPHHRKWLSHKTVLRHMKLHIRLCHKHKWQSMSDQGRTVRAHGQAGSHFVSRGVGLWDADYRFALQARLNQLDTNSTLKRRRQRTNATCRAPNCSRTETLAHVLNHCETNMDVIRQRHDGALEQIGAAINAAIKGRRTDTEVRLNQTVPEFNGPAWRPDIQVRDARSKTMVIADLAITFEDQPNDQSASSSLQHSREHKIAKYQPIAAALERQGWRVHTSAIVYGSLRSVHPSNFTVYTELLGLLKRDARRLNTTLSCHCIRSSRRVWNWHCGQHRARQHQRCQEGRAHGSGGNQRAEGGTATT

SEQ ID NO: 1438 - protein, 1369 aa, Strigamia maritima
MATVRLKYPYPPEGILCGPCAANTNAPQTRPYSDKSGLAKHLKLYHKATLVVECRHCGHEESDLRKMKKHISTNHPVAAAAAPTVPPRLGPTAPPPPRVILRPRFIPRPRTPSPSSSSSSASSPASSRRSVSLPPASPPVSSASSPAARSGRNSPDSQGTAPVTPIGTVRNSPAGSPALSYSTASPIASTITTPRHLSPASPALSAGPGSLGASPPVSPTAATVPPAPPATVPAVMAATVPFVAATTVPSVGSSTVPQRPAGPRRPPPFPIDDWIGRIARVSSLPELDAVSRLLEDEVVKRRPPDPNARPASLHPTRRPPPPSTRPRPCHGTGGTSVSLAALTSSCIREDHRGSLPLLCTSGWDSPWPLSPSPSSHCPSSNPCPSSSTPPSSLLGPPRHSHLTWRGSGSTTPSHRHCSRARYHHLLWRLPYPSSPRLPYPPSALARYPSVPPALDDPLPSLSTIGSEGSPECHLCRNWTPSQGCSRMKWSRDAPLTPTPDPPHSIRHAALPLHLLALVPAMGPAELQSLWRRSRPRAFAKITEGASPFCALPVGTVHGHFLQVHQATAHLPTPVPLPPLRPPRSSDPLVTPISPGEVLDRLRRATDTAPGPDTIIYSEWRAIDPTGRLLSSLFQKVQTFGAPTRWKESTTTLIHKGGDHTAMSSWRPIALLSTVAKIYGSILSHRLTTWAVQNGRLSLSQKGFLPFRGCLDQNYLVQSCLQDARRNKKTLSLAFLDLKNAFGSIPHLTIRHSLEWLGLAPSSIDILEASFLGSSTRVRTETGLTPPISLDTGVVQGAPLSPILFNLAIEPLLRTVPSAHSGFSLHGHVVSVVAYADDLAILAPSTPALQSQLDAISGMADWAGLSFNPAKCATVTLTGKDNSRDTLSLQGSPVPSISDGDAYKHLGVPTGTTTFPSGTDAIKKMTTDLQAIDHSDLAPAQKLDALRTFIMPQLSFHLSHGSVPKAPLTQLDKKIKRAAKHWLFLPQRASNEILYMSHLHGGQSLLPLSVLADIGQVTHAVALLQSRDPAVADLALRTCREVASKRAKKTVNGPELAQYLSGSTDGIYCTPTSDIPSLWTTARAATRRLSSTLPLTWTSPLPSGVPFLSINGSPLSPFRVQSTLTNAIRHNHLSTLIAKRDQGNSYRTSHDPDPSNYWVKGGDFLRFCDWRFIHRARLNLLPVNGARRWDANSIKTCRRCGAPNETLAHVLNVCPVGLPEMKKRHDAIHARIKKALRPSPHTVVHHDRTVPGCGPLRPDILRISERDKSVAIVDIHVPFDNGTDAVERAHETKRAKYELIRRHYEHQGYRVTFDSLVVTALGRLWRGSEAALQALQISSQYSKLLRKLLVADAIHGSRNVYAHHMTGMVM

SEQ ID NO: 1439 - protein, 1305 aa, Strongylocentrotus purpuratus
MSHSITEVFDYPLPSRWKCTVCLENFFNQQTLKRHQARHHQTTSFLYVFRCSACQAEFDSARKASNHWQSHKRKPILSQPAVNEIPSSGLDPSPPRSRPPVEVIGSSFPDDVSMLSEPSTPSTSLQMDPEVVHPPSRSISFSPMHLSPTQPASPIQIGVEVSFNSSSSLQMDPEVVQPPSPSISFSPMHLSPTQPASPIQIGVEVSFNSSGSLQMDPEVVQPPSPSISFSPMHLSPTQPVSPIQIGIEVSFTSSSPLQMDPEVVQPPSPSMSYSPMHLSLTQPDSPIPVDIDVIPAAEVPLPDIEIPPSPDRHPAAEVPLPDIEIPPSPDRHPVAEVPLPDIEIPPSPDRHPQSPPRPVMMEQPVHTPPPADTQQANGPQHWVTVLANATNWEDFGRVCVEFANHAVEAARSRQDAPQVRPAAQRQPRRPTRPRQPTFDVREASRLQKLYKRSKKRAVRHILRDDAPSFSGSNEQLLDYFKEIYAPPEIDENRAQQLAESLFTDLEEAKESAAALMSPISQQEISTRLSRMSNSAPGKDRLEYRHIRQADGACRVTHIMFNRCLQEHRIPSAWKEATTILIHKSGTTDDPANFRPIALQSCLYKLFMGILSDRMTQWACNHNLLSPEQKSARPCEGCHEHTFLLSSVIKDTKRNQKTANIAWLDLRNAFGSIPHQAIHAVLTTIGAPVSLVMLLKDTYTGASTSFLSTSGETDPIQIQSGVKQGCPMSAILFNLTIELIIRAVKKKATDDGLGLVVHGQRLSIMAYADDLVLMSKTPEGLDAILSVASEQAETLRLAFKPTKCASLSLSCRHGTSVLPREYTVQGHLMPALDEEEQYRYLGVPFGLPRFTNLKDLIGKLKGNIETIASSLLAPWQKLDAIKTFVQPGLSFVLRAADYLKSDLRSLKSAITTNVKKICQLPLRAANAYIFAAKESGGLAFIDPNVDADIQVITQAVRVLSSDDEVVQTIATSQLKSVVHRTIHAVPTEEDIDNYLSGSNEGLLANSGNSGQASSLWSRTRSAARRLHLTLRATTSGTVVVNQQADIDHTRDILPASITRGLRLIQRTTNAEKLKSLPDQGKVARSLSNDPFANGSSWHATGKFIRFCDWRFIHRARLNCLPTNVATKRWKANANGKNGHQQETLPHVLNHCLPNMVPIRRRHDNIQQRLVTAIRHGDVFVNQHVPGDPNPRERPDITVIEGNKVTVIDISVPFDNGPNACTTAAQAKVEKYSALRQALRDMGRDVEVHGFIVGALGTWHQGNERALGRLGVSRWYRTLMRKLCCIDAIQASRDIWVEHVTGHRQYE

SEQ ID NO: 1440 - protein, 1701 aa, Trichinella spiralis
MCSAKTPALKSGRRRGKEVNYEGQIVRVERRRGSRSSTSATDLGTRMVTRGRKKLMEASVREAGHHGGESASTVDVDVVESKKITGKTARRNRRAPSGDGKRRESCGAECGQAVCGNAVADRSEASSPRTPNVSKSGRDKCGQPTIKASTPSPPKRKPTTSSSPRTPCLSKRGARSKIPSTPDTPSTSGGSGKQRVLVSPLLRTEKLPDLEVLQRTEEQVTVRATFPIAQAVVCPLGCEKPYTAVRPDGQFAHQTLTRHFMRVHNCHSVQWHYRCRNCNTDFLPADHRYPLRVVNTHVRSCVSRWEITRKLGESEDLHGVRCDLCDYVGVSKRAVGLHRRRHANENIMQNTGTAAQIEALSKQVGEIRVAGDYSQFKFGKRVRQYVAPTQRRDGLDEEEVHEAEEEEVPAESRTILGEPSTATAIGAEEISATGPVRADTAAQQMICRIGQWCVWPQDYHSIPAPQCWTDTLMDLMIEQIVLQRYPDGAGVSVMSCSAVSAAIHHEISAEFAAQVMSSHDASLYCIIPVNVRNHWQMIVLDVAERVVHYYCSLREHNTVVLSSLLSLVELSGKHTGCTSWKIETHDGAPVQTNAFDCGPFSCLFLKHLLHGIDMNFGDRESAALRTDLKFMIDAVSTPVVPATDKLKKKPDGSATQLTQFQQKFLSASDNWQSPDVDLQAVYDEVVESIVSGHNEPSSRNTSRLQKKSPGKGGKGQVRRRSAVTRDPAWLKSASAVQKAFNSAPARTVNAILRRPNACPSFTATQVADHYFNLRPAVTSLAPEVIDILPPPATDHSMLVAELSESEVWEKMQKAPNSAPGADRITIRMVRMADPGAMILTRFYRACLLRKWVPLQWKQSVCKLLYKDGDKERLANWRPIALEPVLQRVLSAVVASRVTNWARANGLISLEAQKGFQPADGTSEHNFVMEVAIQEARRTNAQLAISWLDISNAFGTVSHQLLFSLLERYGLDPTFTSFIQNLYKDATIVVKGANGTHVTARWSVGVRQGDPCSGILFCLFVEPLLRSVLPSLPCEAETTAVNVLGQPITALAYADDIALFAPSIGVMQQQLCKIQGMASAMGFRFNPKKCASLYLNRAVVNAATFTISGEEIPALVHGDTFRYLGVAAGLGKPQTPFSLLRENLREAELIFRSKLAPWQKMDAYRTYVLPRLTFQLMIAKFNNIKQSAGQYDRAILRLVKRCFQLPVETSTDFIRAPRQCGGLGVPSLRELYATAKVSRALKMLWSPCRVVSSLAASQLQRVASAYFAKRLRDVEAADLSTFMNAARSTPLDRSGYPTCLWMDARKQMSYLTKVAGVDCYFLVGEAGTSFFIRNGLGQTVSVLSPLRKNKVMSVLGGAIQTRHLDAWLQCKRQGKTASCIVLDRSSSRFITTGRYTSFAAMRFALPARLDLLPCRARSSMRSYQNCRRCGYDRETLPHILQHCRQFSAPAYQARHDAVQGRLETVMRRRFPNLRVNRALPEIGSNKRPDLVVVDEEKRLVILLDIAIVFENTAAAFVDARTRKWAHYEKEILAYRLRGYSVTYDAIVVGALGTWDPKNDAILKRIGVVSQRYLRLMKVLVVSEMLEHSSRIYRKHLGLRDLLPDTGTKRRPVGTTETDPPGGDLRQKKRNTISARASGGKCLERRFTSPVGTPSQRGELQCQPCPGPRRPALAGIAPNPPSLQPRKPPPRQHQKPVTKSTAH

SEQ ID NO: 1441 - protein, 1195 aa, Chelonia mydas
  MOD_RES (231)..(231): Any amino acid
  MOD_RES (253)..(253): Any amino acid
  MOD_RES (275)..(275): Any amino acid
  MOD_RES (387)..(387): Any amino acid
  MOD_RES (389)..(389): Any amino acid
  MOD_RES (398)..(398): Any amino acid
MLQLRLPTPQTLRLLHPSQLPQSHSTKRWSNIYEERARAPKDTTIERVSAASKIPKLDPAKRRIGAPLQLMQGNSISRQLSASSQYVQHNAVVRRVSAPPHTGNFTGSCRRKLALPHRPPSETQPAESYLHCWTTQRDPTLADQHGLQDHPTGLPPEGSHCIKDPRQNSSTEGQRRSGNSQARRIPKRASTAASKTVLPKRTSAALKSVREDTALVLEDPAKWSSQHREGXRQQANPTAVFQPEPAEIEQQPXVRAATPWQAAWMEELARTASFXDFDLLVDRLTKDLSAEIVSGRKGTQENTPTAHRQNQNNMREARRRNISRCYDPAAASRIQKLYRSNRPKAMREILDGPSSYCAIPSERLFLYFKGVFDRVAQNDMQRPECLXPXPRVDYAEDXEQDFTSWEVEARLTKTKNTAPGKDGIRYNFLKKRDPGCLVLTAIFNKCKQFRRTPSSWKKSMMVLVYKKGKQDNPNTRRPISLCSTMYKLYASCLAARITDWSVNGGAISSIQKGFMSCKGCYEHNFVLQTAIHMARRAWRQCAIAWLDLANAFGSMPHQHIFDMLREFGMPENFLQLVRELYEGCTTTICSMEGETPEIPIRSGVKQGCPLSPIVFNLAMEPLIRAISSGLGGFDLYDNRVNILAYADDLVLIADNPESLQQMLDITSQAANWMGLRFNARKCASLHIDGSRRDSVQATSFQIQGEPMIFLEDGQAYQHLGTPTGFRVQQTPEDTIAEILRDVARIDSSLLAPWQKINALNTFLIPRISFVLRGSAMVKVPLNKADNTIRQLVKKWMFLPQRASNELVYISHRQGGANVPRMGDLCDVAVITHAFRLLTCPDAMVRNIAESALQDAVKKRIARTPSNQDVATYLSGSLEGEFGRDGGDFASLWTRARNATRRLEKRIGCHWTWCEERQELGVLVPQVKNTDHTIITPRARTMLERTLKDAIRCQYVENLKRKPDQGKAFEVTCKWDASNHFLPGGSFTRFADWRFIHRARLNCVPLNGAVRHGNRDKRCRKCGYANETLPHVLCSCKPHSRAWQLRHNAIQDRLARAIPPPVGKVAVNSAIPGTDSQLRPDIVITNEDRKKIIMVDVTVPFENRTPAFHDARARKVEKYAPLAETLRAKGYQVQTHALIVGALGAWDPSNERVLRECGIGQRYARLMRQLMVSDAIRWSRDIYIEHITGHRQYQEG

SEQ ID NO: 1442 - protein, 1465 aa, Phytophthora capsici
  MOD_RES (27)..(27): Any amino acid
  MOD_RES (59)..(59): Any amino acid
  MOD_RES (61)..(61): Any amino acid
  MOD_RES (425)..(425): Any amino acid
MQDMEEELLLDVEMETETTEPQTSTAXDATTTTDRPTRWGPHPRAVAAAAIAQLVTGEXAXPALPSRQDRRPAPRSHAPTRSRWGPRHQAVGAAAIASLATGLPASAAPVSRATKHGEGRRRLQTRWGPRVSIPRAARRPGSRWGPPRAAGASGQLPASASGATGQLPEHVEAITTTPRVASDADEGPTPPDPWILRFDGACRRNPGPGGAGAALFKPSGAVVWTCSHYMPSSNETNNTAEYTALLLGVQSAVHHGATRLDIEGDSSLVIAQVKGTFACRNAKLRQLRNRVRHALRSVEKYTLRHIDRKANAHADRLANRALDRRSSSSECEPHGSCMERCCGTDTTPAVQGPTPQAAAAVPVQVWPQWQRQTMVAWTTSHGGRCRDCSTRCGRSLPSLAHRPRLSPRRQPRLRLRQLSDEERDXAADALQELSDVMASKIVDADSWDTGEGYISSIPERIREVLQPYTTRPPRPGHQQQQRRRPPRVTRNQREHRLDEALDDMQATQQAAPRDQRAIHRARRRVGRVRASMAKQELRQAFAKDESKCVSKILAGASAETAAEEHVDECPIDAATLHAHFTGTNAPRTDFDYDAACGQEFRGALDSMQPPTVATDAFEEELTIDEVEDQLTRAAKTSSPGHDGIGYDIYSRFAAQLVPLLHAAYQFCWLHRRVPALWKLGIVRLIHKKGDPMQPTNWRPICLQPAIYKIYSGLLARRLSRWMEQNQRLPMAQKGFRAFNGCHEHNFVATTLLDQTRRSHRRLYQVWYDLRNAFGSLPQQLMWSVLRHLGVDASFIARCKNIYQDSAFVVANAVDGATDPVRQEVGVYQGCPLSPLLFISALVPLIRRLEKLDGVGVPLAEGVRPCATAYADDIKVFSDSAAGIRKCHDAVTRFLEWTGLRANPGKCASLAVTTNARGNPVRDDGVHLELQGEVIAPLSLHDSYRYLGVGDGFDHVRHRLQLEPKLQQIKREAVALMQSGLAGWQVVKALKTFVYPKVEYALRHLRPLQSQLQGFDRAVVRGLRHLLRLPQSATTEFFYTPTSGGGLGLQSLVEMHQALQVAHAWQMLHSKDAAVVAVAKEQVCQVARKRYRLQEEHWRGRGDELVRLFLNSELAASPFADCLRRNGDIGSLWTDVQRTLRLHHLSLTAQDDRDGQDPLALRVPHHTKWLDHKTVLRHVKLHMKIRHQTRWKGLVDQGKTVRVHGGLGAKFVSTGAGLSDDAYRFGVKARLNQVDTNAVLKRKRLRSSKTCRDPTCSSAETLAHALNHCASNMDAIRQRHDDALEQIGSKIRGALERAKSTTELRLNQTVPEYTGAALRPDIVLRNVAAKKMVIADLAVTFEDHAAGARHSSLQLSHDHKTLKYQPIVAELRVQGWQVQTAAIVYGSLGSVQPSNFKTYTEKLKLHKREARQLDLQLSSHCIQASHRIWGWHCRRHREGQRSGNTSRASRGSGGTPRRTSQVRARR

SEQ ID NO: 1443 - protein, 1812 aa, Phytophthora infestans
MLADPAALAAGLARAPPPPSAPQDPSPAFPAGPAGQNPRAAAPARVEVHTVVAPPGRAGGMLPDPGLVDSSPAAATAATPAPVAATATTARAAARVAVEHHAHAEPNQEHLPMARVLVEPMQVDECSSCDRSTLTADDGSGDDVAAPSSMLSNDVAAPMDVDSGTSCPPTLQQPLQRPRALHVGSKRRRLDADDGEEAHQLQEEEEAGIHAPALRLSAASAQPASVLAVYTHNASRFDCTLCAYTAGSFASLLTHRNSRHRRTAFLDRFSAGCACGVPFASRLAAARHAQACASLSSAPSAEASSAAGTSSPTADGADSTVSAVAHAEPGLPHHNDTELTASPPLVSSSDVEVQATKTEATDNRWGAPLPRVLVASRIAGRLAQVPPPRWGPPLPRTTIAARIATRLAATPAPRWDPPLPRSLVVSRIAARLLPALPDAPACEEEAKDSDTMDWAPTWTNEETKESEPHDEAPGQVDEETIDDADGEWLLRFDGACRANPGPGGAGAALFKPSGPVVWTCSHYDPSTTATNNTAEYTALLLGARAAADHGVTKLRIEGDSTLVIQQVRGIFATRSTRLRALRNKVKLELARVGSFSLHHIDRQANGHADRLANAGLDRRRTKLECSVHPDGRGCTNTSVATAAPTAPAAPLPSARPPASTAAPSPDDDHSDQGDIDDGEVYAAMCISPDAVPHRRPRLRLRRLTDEESEEAGNVVERLAASLAAKIADAPDWETAEGYITALPYALYDKLQPYSQSQHQPPRQQQQQQRQRPRQQQQTRQRRQRRCKRGGGSQHRQRKTRRRRPPRVTRHHREHRIDEALDDLHALESRRPQDRTAISKARRRVGRIRSALDQHQLRHRFDTDEKACVDGILAAARDKDRAASVTTTAQTAAPPHSAPASAPSSAVDDGICPIPGDLLHAFFTDVNTPRTEFDADSPIGARFREALAQLPAAIAATELLMEPPSPDEVEDQLQRVRGTSSPGLDGVGYDVYKTFTQQLLPALHAAFSRCWTDQRVPQSWKLGVVRLLFKKGDRQDPANWRPICLQQAVYKLYAGILAHRFTRWLDANTRHADAQKGFRAVNGCGEHNFLAATLTDNARRRRRELHVVWYDIKNAFGSVPHELLWEVLRRMGVPAQFIACCQGIYDAAAFTVGNAADGTTAPIQLRLGVFQGCPLSPHLFTAVISPLLHALKRLPGTGVQLSAVDRPGASAYADDLKVFSDTKDGITRQHQLVTDFLRWTGMVANPSKCSTMSVQRDNRGVLKTANLTLQLDGAQIPALGMTEAYAYLGIGDGFDHVRRRVELAPKLRELKADTTALMQSGLAPWQVVKALKVYIYPRVEYALRHLRPFQQQLQGFDRHLARGLRHLLRLPTSATTEFLYAPTSRGGLGLLPLTEVHGALQIAHAWQTLHSPDPAIRRIARVQLRQVADARHRLDAEHWKERGEELCERLLNSQLGTSAHAPPKRRNCDIGSLWVDVQRHLRSLGLQLQTAPADTHTGAPAQPLQLRVPHHDKWLTHKDVLRHVKLHIKNNHWHRWTSMRDQGKTARAHGGEGSGFLTQPRGMWEADYRFAVAGRLNQVDTYSVLKRRRLRSHDRCRQPGCHRAETLAHVLNHCPGTMDAVRGRHDGALKRIERELHASATDRRDRVELRVNQTVPSLAGPALRPDLQLYNHTKKTVAVVDLAVAFEEQASDDASSSALSLIASHKRAKYDRIKRHLERQGWKVHLSALVYGSLGAVASGNYQVYTTHLGLLKRDAKRLDRQLSVECIQSSRRIWNLHCSQHRTRQHQARPSQGPRGSRATETGGTPSQTSRR

SEQ ID NO: 1444 - protein, 1595 aa, Phytophthora ramorum
  MOD_RES (337)..(337): Any amino acid
  MOD_RES (1389)..(1389): Any amino acid
  MOD_RES (1441)..(1441): Any amino acid
MSGDVVSSDGSSRTTDASGDGDDGAGSSDAAGDVGVVAMDVDQGARRQQPPWQRVGGKRRRLNDVDDEDTRELAELLLEEEDEAGDHAPAPRLSAASARPASVLSVYAHNAQRFQCTLCTYTAASFASLKRHRDSRHRRTAFLDRFSAGCACGAPFASRLAAANHAHACASLNRTLSVAATPAAGELSPTAGAANATVKAATVTPDSPRQDPPELAASPPLASSPDVAVQAADMQAPTRWDPPLPRTLVATRVASRLTDLTPPRWGPPLPRATVVSRIAARLEAAPTPRWGPPLPRVVVASRIAERLAPPELAADDETKDGEEDQSFTEPVAAARSXGGEDANGEWLLRFDGACRANPGPGGAGAALFKPSGPVVWTCSHYMPSSSETNNTAEYTALLLGMRAAADHGATRVHVEGDSTLVIQQVRGIFATRSTRLRGLRKSVKAEMARMEHVTLHHIDRQANGHADRLANAALDRRKTKLECGLHPDGQGCSSTAATTAVPSVVPDRPPSSTAAAPTPSAEPDETEQGDIDDGEVYAAMCIGPDSIPERRPRLRLRQLSETEEEEAGAIVERLAATLAGKITDASDWATAEGYITALPYTLYDKLQPFAQHRHQPRPQHRQQPQRDPPLGTHDGDHGQPSTSRSRRRRRRAKDRLRRRPPRITRHHREHRLDEALDDLRAVEHASPHDRPAVARARRRVGRVNSAIAQQQLRHKFDKDEKACVDGILAAARASRGLATPSASASRHPPPVPSTAADDGSCPIPSDELHAFFTAVNTPAGTFEPMAPVGAPFRSAVAHLPAATSQPELLSDAPTTDDIEDQLQRARGSSSPGLDGVGYDIYKAFAAQLLPALHAAFACCWRHKQVPQSWKVGVVRLLFKKGERTEPANWRPICLQQAIYKLYAGVLARRLTRWLDANGRHADTQKGFRAMNGCGEHNFLAATLVDQARRKRRELHVVWYDFANAFGSVPHDLLWEALERQGVPSPFIACCRGLYADAVFTVGNAADGTTAPIALRVGVFQGCPLSPHLFTAAIAPLLHALKRLPDTGVQLSRVDCLGASAYADDLKIFSGTEGGTKRQHALVADFLRWTGMRANPAKCCTMSVQRDTRGVLKACNLGLQLDGAPIPALTMSASYAYLGIGDGFDHVRRRIELAPKLQELKHDATALLQSGLAPWQVVKAVKVYLYPRVEYALRHLRPFHQQLEGFDRHLVRGLRHLLRLPANATTAFFYAPVSRGGLGLLPLTELHAALQVAHGWQMLNSKDPAIRRIARVQLRQIADARHRIDAQAWQDREEELAQLLLNSQLGASTGAPPKRRNGDIGSLWVDVQRHLRHLSLKLETAPACAETGTAAAMLQLRVPHHDKWLDHKTVLRHVKLHYKNKHWARWAAMXDQGKTARTHGGAGSGFLTRPRGMWEADYRFAVAARLNQLDTHSVLKRRRLRXHDRCRQPGCTQGGDAGARAQPLRRHHGRGPRPPRRRPQAHRARAARVVAGRPGPRRAPGQPDGAVARRPRATARPPAVQPHQEDGGGGRPGRGVRGAGERRPGELGAGTHRRTQAREVCRRQATPRAPRVEGPPLGARVRLARRGAGRQPQGAY

SEQ ID NO: 1445 - protein, 1614 aa, Pythium ultimum
MDYDDSEFFDAICIPDEDADVLDDGDEGDEGGNDDESSEPLPLAITNAPSAPLHATMLCGTVTQPWLLRFDGACRRNPGPAGAGATLTRPNGIILWTHYRYIPDKTATNNVAEYEALLDGLRCAAHHGVKHLRIEGDSNLVIEQVKGIFACSTSLRPRRDQVREILRHFETYSFRHIDRALNRQADRLANQALDLLKTVSVCALSQTRVQDDTGAAHGCWHWTPPDASPTDDASTSILTQDVPVPMDIDDYDPDEPMNAADDPVSINAEREGGTVYPVLRLGPNVVPERQKRLQIPWLPPREMQKLEKKIEVLGETFASRIRDAPDWFSAEGYITALTSELATLIRQSTAATTGPNAARPCERTISKEKRRARRTTPLQRALAEAKHELQIIQPDASRKSVRKAARRVKRISQAQQRHDLRRLFSTNERRCVEKILRDPPVGPSSTSSSLPATDDDRCTIDPADLFAYFQTQATAPTNFDFDDEGGELFRSVLDELPRADQEVHLLEDEITRDEIEDQLSRISKSTAPGLDGITNAVYVRFKLQLLDALQAAFNACWRYNRVPSMWKAAFVRLIYKKGNRAVPSNWRPICLQQTVYKLYTAILASRLQRWMDANARFTMSQKGFRAFNGCHEHNFVATCLHDQTRRLRKKLAIVWYDLRNAFGSLPHEYLWRVLARLGMPPQFVARVRQLYADASFTVESRDGTTDPVQLERGVYQGCPLSPYLFIAALIPLVRALHKLKDQHGIVLAPGVTDCVSAYADDIKIFARSGTGAKALHEIVVRFLSWTNMAANPAKCALMVTDGARGGDDTDASMTLSIEGETIPRLTGKEGYVYLGVEDGLAHERRATCLRDSLKAASADVVRLLRSDLAPWQIVRAIKSHVLSRFDYVLRHLRPFLSLFDGFDKMLVRGIKRLCQLPQTATSEFLFSPTSAGGLGFLPLKELFAALQIVHALQMLHSKDANVRAIARHQALQVVRKRYALQSDHWSDREEELLEEFFNGTLERSPFALAKKVSGDIASLWTDVRVNLTKYGLKFGEAHGRRLQPLVSHTDKQLAPQQWASAIKTHMRLRHLKRWTTLVDQGKTARMHERIGSAFLTRPSGVYDASYAFAVRARLNQVDTRSALKRKRIVNNSRCRVSGCSELETLAHVLNHCRFGSDSIRARHAETLLLIKTTMERELTRPGRQHQRLLVDATVPEARDPVPSNDAAESNIGAMAPSISHLRPDIQLYDNKTMEAVIIDLAVAFEDQSTDDAASSSSFARVKGVKTKKYEVIKQFLEYKGYTVHVAALVYGSLGSVDTGNFAVYTERLGLRKGAVRRLECSLSARHINFAHRMWRRHAIAHTTGLRLIGTNSVQQQGVQRAPAEKQQHQRPVQRPSRAQAPRDQPSQQQQSQQSFQQQSQQSQQSQQSQQSQQSRQRHAPTPTPVPVPVPVPVSTPTLTPTPTPTRRPKPAPSSTQPQQGAPAQRRQQREQKKQPACRRRHATAVRETPPAAPTAARTATPTARPTATTRSTSTTRSTATATSTTRSSAPTSRPSAPRPRSSAPRPRSSAPTTRSAAPTTRSAAPTAIATTSVYKSRRTTNAISGATTRRSASSKRAPMQPRTALTPTQQQQRQ

SEQ ID NO: 1446 - protein, 1983 aa, Phytophthora infestans
MPRSLASEPVHSSASRLPSQAPPTSRSGAAHTPPPSLQARPLASADAGLAATALASPQDPPYDVAPPGRAAGRLPDSVSPGATLSAATARALAVRHWPLELDSDSSDDEDAQDPHAAAPGPPADVASVLAPPGRAGSMLADPAALAAGLARAPPPPSAPQDPSPALPAGPAGQNPRAAAPARVEVHTVVAPPGRAGGMLPDPGLVDSSPAAATAATPAPVAATATTARVAVEHHAHAEPNQEHLPMARVLVEPMQVDECSSCDRSTLTADDGSGDDVAAPSSMLSNDVAAPMDVDSGTSCPPTLQQPLQRPRALHVGSKRRRLNADDGEEAHQLQEEEEAGIHAPALRLSAASAQPASVLAVYTHNASRFDCTLCAYTAGSFASLKTHRNSRHRRTAFLDRFSAGCACGVPFASRLAAARHAQACASLSSAPLAEASSAAGASSHTVDGADSTVSAAGHAEPDLPRHNATELTASPPLVSSTDVEVQATETEATENRWGTPLPRVLVASRIAGRLAQVPPPRWGPPLPRTTIAGRIATRLAATPAPRWSPPLPRSLVASRIAGRLLPALPDAPACEDEAKDSDEMDWEASEPHVEAPGPVDEETIDDADGEWLLRFDGACRANPGPGGAGAALFKPSGPVVWTCSHYDPSTTATNNTAEYTALLLGARAAADHGVTKLRVEGDSTLVIQQVRGIFATRSTRLRALRNKVKLELARVGSFSLHHIDRQANGHADRLANAGLDRRRTQLECSVHPDGRGCTNTSVATAAPTASAAPSTPTRPPATTAAPFHSDQGHIDEDDERRADIDDGEIYAPMTLGPDEVPARRPRLRLRQLSDEELEAAGAIVERLSASLSAKITDAEDWGTAEGYITALPHLLYDKLLPYSRTAPRHQRPPRPSRNQQDHPQPRRDQPQRNVDEQQHAESQQGEDQRQQQPPTRRRRRRGKRRGRRQRRHPRQPGQSTRASQQSRQRRPRPPRVTRHHREHRIDEALDELHTLERARPQDRSAIDKARRRVGRVRGAINQHLLRHRFDTDEKACVADILEKAHAARAARTAQAAGAATSTGGAATAPTQQAATSALGDADDGTCPILADELWQYFTGTNTPRWEFNPATPVGEAFRTAMARLPPATRLRELLTEAPTADEIETQLQHVRGSSSPGLDGIGYDVYQRFAQQLLPVLTASFKRCWTAKMVPQSWQVGVVRLLYKKGAHDDPANWRPICLQQAIYKLYTGVLARRLVRWLDVNDRHAPGQKGFRAVNGCGEHNFLAATLIDQARRKRRSLYEVWYDFRNAFGSVPFQLLWDSLQRLGAPADFIDMCKGLYHQAAFVIGNAADGPTAAIRQQVGVFQGCPLSPQLFNVAISPLLFALRRLPETGVQLSGDDRVGVSAYADDLKTFSSTKAGATKQHELVAAFLAWTGMKANAAKCSSMGVRRNSNGATEADNLDLALDGTPIPSMTHMQSYTYLGIGDGFDHVHRRIELAPKLKTLKQDTTALLESGLAPWQVVKAVKVYLYPRVEYALRHLRPEDQLLESFDLHLRAGLRHLLRLPKNANNDFFYSPVSRGGLGLLPLVELHAALQIAHGWQMLNSTDPATRRIAREQLHQIADARHRLDKAHWKERGDELCQLFLNLDLGTSAHAPPKRRNCDIGSLWVDVRKNLQAFGLKLETAPADAESGTPALPLQLRVPHHEKWLTHRDVLRHVKQHLKNKHWRAWCAFQDQGRTARAHGGVGSSFITRPRGMWESDYRFAVAARLNMVDTSATLARRRLRAHDRCRYPGCRWKESLEHVLNHCPGTMDAVRGRHDGVLREIEHALRAPSGARRELRVNQTVPGLPGPALRPDIQVYNHDQRTVAVVDLAVAFDRQDRDDPETSGLAKAAAEKKAKYTGIQRHLERQGWKVHLSALVYGSLGSVAPNNYKVYTEHLGLLKRDAKRLDRTLSVACIQSSRRIWNLHCAKHRARQHQTPSQSRGRRVTETGGAPSRTDRR

SEQ ID NO: 1447 - protein, 1493 aa, Phytophthora ramorum
MQDQVDAEQQARNRWGPPLPRPLVASRVAARLGEVPPPRWGPPLPRGVVVSRIAARLEAVPVPRGGPPLPRSFVATRIADRLAPPSPDLSLLDEEMKESEPPDPTHHSADEDSTDAETADAVMEPAFVSDPPTATPREWRLQFDGACRGGPNPGGAGALLYNPEGAVVWTGSHYMPGAKETNNSAEYTALLIGARAAADHGARQLRIEGDSLLVIRQVKGLYATKSTRLRQLRNAVRHELARVGQHSLHHIDRQGNAFADRLANRALDLKSDKVECKEHPVAGACTTCMGSPSAGPPATPPPTTADIEMADAGSDDELRADIDDGEVYAPMRLEPGVIPTRRSRLRLRQLTDDEMEAAGEVVERLSAGLSAKIADADDWETAEGYITALPYMLYDKLQQYTQVRHGTARSPAPHPQRRDVQGQVETHREPRHETIGQPDQPGEPSPTRRRRRGKRKGRRQRRHPRRTNCGGGGRQQRKQRHPRPPRGTRHHREHRIDEAIDELHALERARPQARPAIAKARRRVGRIRSAIDQQLLRHRFDTAEKECVDGILAAARTARDARTTVRAAAATGTTATPETAVTSGTEQQDDNGTCPIPSEVLWRHFDSVNTPQRDFDPEAPEGAAFRSAMARLPAATRFMELLKEEPSTDGIEVQLQHASSTSSPGLDGVGYDVYKRFASQLLPVLKAAFKCCWTHKQVPQSWKLGVVRLLYKKGDREDPANWRPICLQQAIYKIYTGVLARRLTRWQDANDRHAPGQKGFRPVNGCGEHNFLAAMLIDHARRKHRPLYEVWYDFRNAFGSVPLGLLWDALERTGVPAEYIAAVQGLYDHAAFMVGNAVDGSTAPILQRVGVFQGCPLSPPLFSAAISPLLHALQLLPSSGVQLSGDDRPGVSAYADDLKTFSGTKAGVTEQHELVAMFLRWTGMAANPAKCRSMGVRRNGNGAIEADHLELALDDTPIPTLTHLQSYTYLGIGDGFDHVRRRVALAPKLKLLKQDATALMESGLAPWQVVKAVKGYLYPRVEYALRHLRPDDQLLESFDLHLRRGLRHLLRLPKSANNDFVYAPVSRGGLGFLPLVELHAALQIAHGWQMINSPDPAIRRIAREQLHQVADARHRLDKDHWKQRGDELCELLLNGELGTSAHAPPKRRNGDIGSLWVDVRKNLKAFGLKLATAPADPESGAPAKPLQLCVPHHAEWLDHRNVLRHVKQHMKNKRWRAWCSHVDQGRTARAHGGVGSGFLTRPRGMWESDYRFAVAARLNMLDTVNVLARRRLRAHDRCRHPGCRWKETLAHVLNHCPGTMDSIRGRHDDALKEIERTLHASSGDRQGRTELRTNQTVPGLAGPALRPDLQVYNHDQRTVAVVDLAIAFDEQPRDDPESSGLAKAAAEKKAKYAGIKRHLERQGWKVHLSALVYGSLGSVAPSNYKVYTEHLGLLKRDAKRLDRQLSVACIQSSRRIWNLHCAQHRARQHQDQPAPRGRRVTETGGTPSRTDRR

SEQ ID NO: 1448 - protein, 1716 aa, Phytophthora infestans
MLADPAALAAGLARAPPPPSAPQDPSPAFPAGPAGQNPRAAAPARVEVHTVVAPPGRAGGMLPDPGLVEEPIQATYAHDAAQFECALCPYVAESMAVLVQHRRSAHRGTRFKDIFTSGCQCSLVFYARIVAASHAVACARRNQRAVPPAPTPVAPTRPEATPQPTGYLAAAMTAAAAAASSDTVVAAATNMQSAVPAAAKTTGLQLVPPELEPALPQRASCHAGKRRRLNADEAVTPCTPTARVSPQTEVAMAPHDAPQDDTVLQREAAEPQPDPAATQGAQVQRVEDTTAAQDDTVQQDHDADTAQVSPPRRTPTRWGPRPSSTQEPSPMTGEPAATLAARRPLTPAATGTRATRWGPCHRAIGAAAIARLVTGLPTEPAQPQRRQPPPPQEPPLQPEPQAAAATVAADIAATVAADIAAAAANAAMDVDGGPAADETWLLRFDGACRRNPGPGGAGAALFAPSGAVVWTCSHFMPSRSETNNTAEYTALLLGAQSAVHHGAKRLNIEGDSHLILSQVRGAFACNNKRLRSLRNRVQASLRQLDWYRLQHIDRKANQHADRLANRALDLRRTVTECGPHAETRNRCFQTPQPLVEPGETHCVPGSDEVLAANTAMEDATAVPTEDDEAEVAARDGGEVFPTIAIGPDSAPAKQPRLRLKKLDEDDFDAAAAAVTRVSEELASKIVDAGDWTSGEGYISAIPERLRAALRPFALPTQPARPQPREPRMQQPPRRPPRVTRDHLEHRLDEALDTMENVQRSTPQNQKAVRRARRRVGRLRSAMDRTRLRKKFATHERECVAEILRRASTEEAANPSQEKCPIDRATLHEYFTATSTQRTPFDYDSAKGTEFRTFLEVMSTPSHETSALTAEPTLDEIEDQLAHVKAGSSPGHDGVGYDVYRRFQVQLLPLLHAAFRFCWRHRRVPALWKVGFVRLLHKKGDPQQPNNWRPICLQTAIYKLYSGLLARRLSKFLEANELLPMAQKGFRAFNGCHEHNFVATTLLDQTRRMHRRLYQVWYDLRNAFGSLPQQLMWGVLRQLGVTEEFVARCSGIYEDSYFVVGNASDGATEPVRQEVGVYQGCPLSPLLFITALVPLLRALENQDGVGVPLADGVRPCATAYADDIKVFCDSATGIQRCHALVTRFLEWTGLQANPAKCAFLPVTRSQHSNPTRDRDIELRIHGEAIATLGLQESYRYLGVGDGFDHVRHRLQLEPKLKQIKREAVALLHSELVPWQILKALKVYIYPKVEYALRHLRPLKSQLQGFDSAIVRGLRHLLRLPENSHDGLFFSPTSAGGLGLLSLVELHEALQVAHAWQMLHSKDPAIRAIARTQVGQVARKRFKLVEEHWRGREDDLAQRFLNTELAASPHATETRRNGDIGSLWNDVRDTLQTLGLKFAAGDEEEAPGLLQLRVPHHTKWLSHSTVLRHVKLHMKLRRMDTWKSKVSQGTTVREHGGVGSRFITAGAGLSDAEYRFAIAPRAHLIDTNSTLKRRRLRANDTCRAPGCSYTEPPAHILNKCSPNMDAIRKRHDDALERIADALRRKVEKSGGRLEVAINKTVPEYDGAALRPDIVLRNTETKRAIIADLAITHENQPTDATTSSALQQSRDNKITKYQTVAAAMMRAGWRVRVTGIVYGSLGSVLPSNFKVYTELLALLKRDARRLNRQLSSHCIRASARIWSAHCRRHRERQRSGNASRASRGSGGAPRRTSQASARR

SEQ ID NO: 1449 - protein, 1546 aa, Phytophthora ramorum
MSGDVVSSDGSSRTTDASGDGDDGAGSSDAAGDVGVVAMDVDQGARRQQPPWQRVGGKRRRLNDVDDEDTRELAELLLEEEDEAGDHAPAPRLSAASARPASVLSVYAHNAQRFQCTLCTYTAASFASLKRHRDSRHRRTAFLDRFSAGCACGVPFASRLAAANHAHACDSLNRTFSVAAAPAAGELSPTAGAANATVKAATVTPDSPRQDPPKLAATPPLASSALVVDPDHAEQQARERWGPPLPRTLVAGRVAARLSEVPAPRWGPPLPRGVVAFRIGHRVLPPEMTSDEETKDDSSVQDGDRQDYPVAAMDVDSGMSGEWLLRFDGACRANPGPGGAGAALSQPDGSVVWTCSHYMPSSSETNNTAEYTALLLGTRAAADHGTTTLRVEGDSTLVIQQVRGIFATRSVTLRHLRDQVKLELARVGRFSLHHIDRQANAHADRLANRALDLRRTVSECGVHPDGNGCTPTAIDDRPLAPTQQPPDAPPPPPAADIEMEDPDDEDLADIDDGEVYAAMRVGPNATPQRRRRGRSGTAKKHRRQRPPRVTRHHREHRLDEALDDLHAVERSTPSDRTTVRRARRRVGRVNSAIEQQRLRHRFDTDEKACVTDILAKACATREAARTTASGGDPPAGPATPAAGSADDGTCPILGEELWRFFDSVNTPRQEFAPDAPVGAAFRSALARLPAATSCKELLTAAPSAGEVEDQLQHVRGASSPGLDGVGYDVYQHFAAQLLPALTAAFKACWTAKRVPQSWKLGVVRLLHKKGAREDPANWRPICLQQAIYKLYTGLLARRLVRWLDANDRHAPGQKGFRAVNGCGEHNFLAATLVDQARRKRRTLFEVWYDFRNAFGSVPFALLWDALARLGVPDDYVTMCKGLYESAAFVVGNAIDGTTDPIALRVGVFQGCPLSPQLFNAAISPLLFALQRLPATGVQLSGDDCPGASAYADDLKIFSGTEDGIKRQHALVADFLRWTGMAANPNKCCTMSVQRDGRGVLKTDDLQLDLAGTPIPALSMSASYTYLGIGDGFDHVRRRVELAPALKQLKDDATTLLQSGLAPWQVVKAVKTYLYPRVEYALRHLRPFQQQLEGFDRHLARGLRHLLRLPGNATAECFYAPVSRGGLGLLPLTELHAALQVAHGWQLLNSKDPAIRRIARVQLRQIADARHRIDSRAWEGRDEELCELLLNSQLGTSPDAPPKRRNGDIGSLWVDVQRHLRTLGLKFATAPACADAGSAATTLQLRVPHHDKWLDHRTVLRHVKLHVKHRHWSKWAAMRDQGKTARAHGGAGSGFLTRPRGMWEADYRFAVAARLNQLDTHSVLKRRRLRAHDHCRQPGCSRAETLAHVLNHCAGTMDAVRGRHDDALKHIERALHASSPGGQDRVELRVNQTVPSLAGPALRPDLQLYNHTKKMVAVVDLAVAFEEQASDDPESSALARIAAHKRAKYAGVKRHLERQGWKVHLSALVYGSLGAVPAGNHKVLTEHLGLLKRDAKRLDRQLSVACIQSSRRIWNLHCSQHRARQHQAPGGSRAAETGGTPPRTGRR

SEQ ID NO: 1450 - protein, 1392 aa, Phytophthora infestans
MARVLVEPMQVDECSSCDRSTLTADDGSGDDVAAPSSLNSNDVAAPMDVDSGTDCPPALQQPPQRPRALHVGSKRRRLDADDEEEARQLQEEEEAGIHAPALRLSAASAQPASVLAVYTHNASRFDCTLYAYTAGSFASLKTHRNSRHRRTAFLDRFSAGCACGVPFASRLAAARHAQACASLSSAPLAEASSAAGASSHTVDEADSTVSAAGHTEPDLPRHNATELTASPPLVSSPDVEVQAPETEATENRWGTPLPRVLVASRIAGRLAQVPPPRWGPPLPRTTIAGRIATRLAATPAPRWDPPLPRSLVVSRIAARLLPALPDAPACEEEAKDSDTMDWAPTWTNEETKDSEPHDEAPGQVDEETIDDADGEWLLRFDGACRANPGPGGAGAALFKPSGPVVWTCSHYDPSTTATNNTAEYTALLLGARAAADHGVTKLRVEGDSTLVIQQVRGIFATRSTRLRALRNKVKLELARVGSFSLHHIDRQANGHADRLANAGLDRRRTKLECSVHPDGRGCTNTSVATAAPTAPAAPLPPARPPATTAAPSHDDDHSVQGDIDDGEVYAAMCIGPDAVPHRRPRLRLRHLTDEESEEAGDVVERLAASLAAKIADAPDWETAEGYITALPYALYDKLQPYSQAQPQPPSQQQQQQQQRPRQQQQTRQRRQRRGKRGGGSQRRQRKTRRRRPPRVTRHHREHRIDEALDDLHAIESRRPQDRTAISKARRRVGRIRSALDQHQLRHRFDTDEKVCVDAILAGARASQGATTAPPSATTDPPAPMDDSRCPIPGDDLWRFFDSVNTPRRSFDAEAPDGAAFREAMACLPAATRAQELLTEAPTVDEVEDQIQHARASSSPGLDGVGYDIYKQFAAHLLPALHTAFVCCWNHKRVPQSWKLGVVRLLHKKGDRQDPANWRPICLQQTIYKLYAGILSRRFVRWLDANARHAEAQKGFRAMNGCGEHNFLAATLVDHARRKRKELHVVWYDLANAFGSVPHDLLWETLARQGVPPTFVDCCRGIYSDAAFTIGNAADGTTAPIRLRVGVFQGCPLSPHLFTAAIAPLLHALKRLPVTGVQLTGVDRPGAAAYADDLKTFSSSVDGIKRQHELVATFLRWTGMAANLSKCSAMSVQRDSRGVLKTGDLCLKLNDAEIPALSMTASYAYLGIGDGFDHVRRRLELAPMMKQLKHDATALMQSGLASWQVVKAVKVYLYPRIEYALRHLRPFKQQLEAFDEHLRRGLRHLLRLPTNATSAFFSAPTSRGGLGLLPLTELHAALQIAHGWQILNSPDGATQRIAREQLREIPDARHRLDTAHWRNRDAELCELLLNSQLGQSSHAPPKRRNCDIGSLWIDIRRQLGTLGLKFETAPGRRSHQPARPAIAAFACRTTTSG

SEQ ID NO: 1451 - protein, 1606 aa, Phytophthora ramorum
MSGDVVSSDGSSRTTDVSGDGDDGADGAGSSDAAGDVGVVAMDVDQGARRQRPPWQRVGGKRRRLNDVDDEDTRELAELLLEEEDEVGAQAPALRLFAASAHPASVLSVYAHNAQRFVCTLCAYTAASFASLKRHRDSRHRRVSFVDKFSAGCACGTPFGSRLAAARHAQACASLSIPRTVTAPAAAGDLSPTATGANATASAAATSPDLPRPASPELAASPPQTSPFDVAIQADAAEQTAWTRWDPPLTRAAVAARVASRLAVVPAPRWGPPLSRTLVASRIAARLDAQTSRWGPPLPPAMVASRIASRLAAMPAPRWGPPLLRTVIASRIADRLLPPELAADEETKDDDVHMDNAASVDVDEESEVADVVMTDHDGEWLLRFDGACRANPGPGGAGAALFKPSGPVVWACSRYMPSSSATNNTAEYTALLLGARAAADHGATHLRVEGDSTLVIQQVRGIFAARSTRMRALRNQVQSELARVGSFSLHHIDRQDNAHADRLANRALDLRRTVIECGIHCDGVGCTATTTEVQSSSAPEIPTRPVADDHDEHEVVDVVDVCGVCGVCGDRGTCGVCDVSGDIDDGEVYAAMRTGPDAVPARRPRLRLRKLTDEEQEEAGTLAERLGATLAAKIADARDWESAEGYITALPYLLYDKLLPYSQGPARSLPVRQHQRQQQQPDGQFQRPTQSRSAARRQRRQRHRARRRPPRVTRHHREHRLDEALDDLHAVERATPSDRRSIRRARRRVGRVNSAVEQQRLRHHFDTNEKGCVEILLAKARAQRSTTVARTAVGEPNSGAAEDDGTCPIPSERLHRHFTEVNTPGSSFDAMAPVGAPFRAALAHLPAATEASELLTEAPTPDEIEDQLQRAKGTTSPGLDGVGYDVYKAFSTQLLPVLHAAFQCCWQHHRVPQSRKQGIVRLLYKKGPREDPANWRPICLQQVIYKTYAGVLARRFTRWLAANGRHADAQKGFRTVNGCGEHNFLASTLIDHARRSRRELHMVWYDLKNAFGSVPQELLWEVLQRMGVPPAFVEVCQGLYQDAAFTVGNAADGPTDLVRQLVGVFQGCPLSPHLFTAAISPLLHALDRLKDTGVRLSADDRPGASAYADDLKIFSGTADGVKRQHALVADFLRWTGMVANPNKCCTMSVQRDGRGVLKACDLELQLDGARIPSLIMNASYAYLGTGDGFDHVRRRIELVPALMQLKDDATALLQSGLAPCQVVKAVKTYLFPRVEYALRHLRPFQQQLEGFNRHLVCGLRHLLRLPVSATTSFFFVPVSRGGLGLLPLTELHAAPADRRPAPPPRPRPLEGAGGENMRAADQLAARDVGPRPTQAPQRRHRLVVGRRPAPPPRTRPQARDRAGVRGDRHRGGDAAASRAAPREVAGPPHGPAAGEAAHEEQALAAVGRDEGPRQDRPHPWWCRERLPHAASRPMGDRLPLCSGGSAQPAGHAQRAEAPAPPRARPVSTAGLLPCRDTGTRAESLRRHHGRGPRPPRRCAQDHRARAHRVVRAARTAPSSGSTRPCPRSPAPRCGPTSSSSTTPRRRWRWSTWPWRSRSRRATTPRALRWRASPRTSEPSTPASSGTSSAKGGRSTSRRSCTARWAR

SEQ ID NO: 1452 - protein, 1540 aa, Ciona intestinalis
MATSSSSVSSGNVQTEVRCVYHGKGDLLLECPVAHCPSIHPTVATITKHLKKHHTPQFEQITTKNLTITYTCSQCSFSTTGLTQHHISKHYKTCKGVGAVQEGNKGRFCCPACGTRWALLCKARHHFNNVHFEYDTPPIAAFSGTPYKLKKRKFTIINKALTYSCPLPLNQLLCPLWSCSLTILNKPLSSVQQETAHGDGSQGQSYVPTQLRQVLRARCHCGNPPIGKGHWASCQGKRPLSSPKGGRSSPTPPANLTLHFLNYLPFQLPSQSSSPQSSTLDPTACKARVPIPSFLRGDCEVTFFIIPSVNFYRPYLSYPLRMFWRNRTSSGHCSLHRVVRGFVRERLVPHPRSKSPARTPLEFLCEFRLAGVFPDPGKVASLRPVPAPLTLCLSPPVAGPMISCEDHSAPPSVRSSSPIPNSPASVSSVEAHLSDLLDKVSSGELRPLSPTLPSSGFFGPLLPPTPPPRPTPSAEKASPSGLSYLPCREVKIASIARPSPASQRVGCDADRTGPSLNPNYQQTSPPSTPSFSPIVRPPKFPRSGAKVNSKSKPPGVRPRRAKPIEPGTESASPVDVDTISSSVQEPCTPENRTPEFFYERKWLVSILNIHEREGSNFFQFNRDLEYWTQLLSGSQKGGRAKRASYNRGAANQAMKNRDSGRKDFDPRPVAGHSSGGGTELGSRPRYPKGARLRADFWRDMKGTVRKLLDGSNGERRCGIPLDIIERKFRQVSMPGWIDHRRYAAGASPSLVTQAETDVAITSEEVEAVLSGLNVQSAPGSDGLSYRFWKGLDPSGRLLSCLFEIVRRHGRIPGAWPTCSVILLCKDAQGDVQDVGNWRPITICRTLYKLYAAVIARRIQTWAKQGGVLSRLQKGFMPVEGVFEHVFMLDTVLSDAKLRRKNLLAVFLDVRNAFGSVRHECLLKVLRHFDAPHYLVELVRDIYTGATCRVRSSVGETGDIPCDRGVRQGYPLSGILFNLVTEVLIPGLSAGNDGYRMACLGGKLTQVLAYADDLVVVTENRDQMLRQLGVCEEFGRWAGLAFNQRKCGLIGWRTLRGGRRVALEDPLLLNGVEIPLLRPGEHYKYLGAMTGVMSVPRTGSQLIKDFRARLQRLFTSFLTPHQKLIALKRFLLPSLSFHLRVRPIARSELIALDRRVRECLRVAFRLTKPSCQAVFHTPTDMDGLGVPSVCSESSILTIAQGFKVLTSPDGTVSATASARVKLYAAKFGGLTEAGPSDWARYLSGDDVNGNSTRKPGANLPSGLWTRVRCASRQLGAVWRVCPENGITVRVRNSVITSRDRRKLIRSFHDCSNQQWKEQWMQHPNQEKTAAAHMAYADANRWVKQPSVMEPHTYFFALRARLNLLPTRVSRAIYSRDQHPDILCRRCGASVESLPHVLNHCPPNMSIILGRHNLVLQEVLNAVDKTQFKEISVDRTVPEHMSETGEALRPDIVARRNDGSVVVVDVACPFDQKANFDEAAKRKLLKYDKLCCNIAASTGKPVECHSIVVGSLGSLAEGLSTSLRALGITDFARSKLVACHQG

SEQ ID NO: 1453 - protein, 1144 aa, Schistosoma mansoni
MPVSTGAETDITSSLPIPASSIVSPNYTLPDSSSTCLICFAIFPTHNILLSHATAIHHISCPPTPVQDGSQQMSCVLCAAAFSSNRGLTQHIRHRHISEYNELIRQRIAVQPTSRIWSPFDDASLLSIANHEAHRFPTKNDLCQHISTILTRRTAEAVKRRLLHLQWSRSPTAITTSSNNHTITDIPNTEARYIFPVDLDEHPPLSDATTPNASTHPLPELLVILTPLPSPTRLQNISESQTSHESNKNSMHTPPTYACDPDETLGATPSSTIPSCFHSYQDPLAEQRGKLLRASASLLQSSCTRIRSSSLLAFLQNESTLMDEEHVSTFLNSHAEFVFPRTWTPSRPKHPSHAPANVSRKKRRKIEYAHIQRLFHHRPKDASNTVLDGRWRNPYVANHSMIPDFDCFWTTVFTKTNSPDSREITPIIPMTPSLIDPILPSDVTWALKEMHGTAGGIDRLTSYDLMRFGKNGLAGYLNMLLALAYLPTNLSTARVTFVPKSSSPVSPEDFRPISVAPVATRCLHKILAKRWMPLFPQERLQFAFLNRDGCFEAVNLLHSVIRHVHTRHTGASFALLDISRAFDTVSHDSIIRAAKRYGAPELLCRYLNNYYRRSTSCVNRTELHPTCGVKQGDPLSPLLFIMVLDEVLEGLDPMTHLTVDGESLNYIAYADDLVVFAPNAELLQRKLDRISILLHEAGWSVNPEKSRTLDLISGGHSKITALSQTEFTIAGMRIPPLSAADTFDYLGIKFNFKGRCPVAHIDLLNNYLTEISCAPLKPQQRMKILKDNLLPRLLYPLTLGIVHLKTLKSMDRNIHTAIRKWLRLPSDTPLAYFHSPVAAGGLGILHLSSSVPFHRRKRLETLLSSPNRLLHKLPTSPTLASYSHLSQLPVRIGHETVTSREEASNSWVRRLHSSCDGKGLLLAPLSTESHAWLRYPQSIFPSVYINAVKLRGGLLSTKVRRSRGGRVTNGLNCRGGCAHHETIHHILQHCALTHDIRCKRHNELCNLVAKKLRRQKIHFLQEPCIPLEKTYCKPDFIIIRDSIAYVLDVTVSDDGNTHASRLLKISKYGNERTVASIKRFLTSSGYIITSVRQTPVVLTFRGILDRASSQSLRRLCFSSRDLGDLCLSAIQGSIKIYNTYMRGT

SEQ ID NO: 1454 - protein, 1132 aa, Bombus terrestris
  MOD_RES (46)..(46): Any amino acid
  MOD_RES (59)..(59): Any amino acid
  MOD_RES (89)..(89): Any amino acid
  MOD_RES (172)..(172): Any amino acid
  MOD_RES (204)..(205): Any amino acid
  MOD_RES (217)..(217): Any amino acid
IAKFDNNTNSASDAAPLSPGGAVADLSASEGTTDNDQAMSPAMSLXTVPLVGNRVACPXCEKREANLFFLNLSDLDRHLTQHHPDAPIXWSCIDCAKCFPKLHGARCHIPKCGGASSQARTGEFQCEACPMSFGSRRGLSTHERHAHPAVRNIKRRGADPPEENTKSWKVEXVARLKGLWEIFKDHKYPNKEISKFLTTKTVDXXKYQRKKLNLIGXESPQEATSLATEGGCDLVSSGNASFGSPVGRNENEEELIHEWKLSLKNEINKPTEVPPILKEVYNRLMLIWEEHQDDRDSLTESLDHFIRTALYELINKINKNQTDLKTKRAAKTKSPKNNRNSRKRFSYARCQELFHECPRRLADAVVNNDQAYLEPARQPPGSEEVRGLYEKLWGQVGSTYVPAPVTRVPKLSLSEIFPPIAAEDVGERIGKIRKKAAAGPDGLQRDHLTIPGLPIIMAKIYNILVYCSYFPSAWKENRTTLIPKINKPCSLVENWRPITISPILGRIFSSIIDGRIRRGTVLNMRQKGFTSENGCKINIELLNSALNYSKRNSGGIFTIVDISKVFDTVPHAALKPCLAKKGVPALIVDLIDEMYKNVKTTIKTKDGGVEIMIRRGVKQGDPLSPLLFNLCLEPLLEEIEEQASGINVSEHRKVSVLAFADDIVLLGADAREAQHQINVLTDYLQSLMMNLSIEKCQTFEVVAKKDTWFIKEPGLKIGNQIMPTVDPDEAFKYLGAKIGPWKGVHCGVIVPELLSVVKRVRKLSLKPGQKVELLTKYIFPRYIYHLLVSPPSDTVLKLLDSEVRQEVKTILHLVPSTATGFFYTPKACGGIGIPRFEHIIKLGTLKSAIKIANSIDPAVAGLIDDAAIKKLKQTANSLRINWPASLEDIEKARKRLRKEHISQWADLKCQGQGVPDFIKNKTGNLWLEDHSLLKPSRLIDALRLRTNTFGTRSVLARADKNIDVTCRRCRAQPETLGHILGLCQHTKGLRIKRHDEVKSLLEGRLKSKKNNEVFVEPTIKAGGSLFKPDLVIKNGERVLVVDVTVRYENKNYLALAEKEKIEKYRPCLRALKEIFNAKGGEILPVVLGSRGTITPNTEKVLKRLGIANNDIKTILLNVLRSSIELCNIFIDD

SEQ ID NO: 1455 - protein, 1186 aa, Crocodylus porosus
  MOD_RES (16)..(16): Any amino acid
  MOD_RES (18)..(18): Any amino acid
  MOD_RES (27)..(27): Any amino acid
  MOD_RES (33)..(33): Any amino acid
  MOD_RES (49)..(51): Any amino acid
  MOD_RES (63)..(63): Any amino acid
  MOD_RES (66)..(66): Any amino acid
  MOD_RES (88)..(88): Any amino acid
  MOD_RES (90)..(90): Any amino acid
  MOD_RES (95)..(96): Any amino acid
  MOD_RES (120)..(120): Any amino acid
  MOD_RES (122)..(122): Any amino acid
  MOD_RES (128)..(128): Any amino acid
  MOD_RES (133)..(133): Any amino acid
  MOD_RES (155)..(155): Any amino acid
  MOD_RES (168)..(168): Any amino acid
  MOD_RES (173)..(173): Any amino acid
  MOD_RES (182)..(182): Any amino acid
  MOD_RES (184)..(184): Any amino acid
  MOD_RES (186)..(186): Any amino acid
  MOD_RES (192)..(192): Any amino acid
  MOD_RES (195)..(195): Any amino acid
  MOD_RES (203)..(204): Any amino acid
  MOD_RES (218)..(218): Any amino acid
  MOD_RES (237)..(237): Any amino acid
  MOD_RES (260)..(260): Any amino acid
  MOD_RES (271)..(271): Any amino acid
  MOD_RES (280)..(280): Any amino acid
  MOD_RES (285)..(285): Any amino acid
  MOD_RES (311)..(311): Any amino acid
  MOD_RES (347)..(347): Any amino acid
  MOD_RES (353)..(353): Any amino acid
  MOD_RES (357)..(357): Any amino acid
  MOD_RES (365)..(365): Any amino acid
  MOD_RES (367)..(367): Any amino acid
  MOD_RES (369)..(369): Any amino acid
  MOD_RES (386)..(387): Any amino acid
  MOD_RES (401)..(401): Any amino acid
  MOD_RES (410)..(410): Any amino acid
  MOD_RES (413)..(414): Any amino acid
  MOD_RES (445)..(445): Any amino acid
  MOD_RES (457)..(457): Any amino acid
  MOD_RES (459)..(459): Any amino acid
  MOD_RES (483)..(483): Any amino acid
  MOD_RES (490)..(490): Any amino acid
  MOD_RES (505)..(505): Any amino acid
  MOD_RES (516)..(516): Any amino acid
  MOD_RES (523)..(523): Any amino acid
  MOD_RES (528)..(528): Any amino acid
  MOD_RES (533)..(533): Any amino acid
  MOD_RES (545)..(545): Any amino acid
  MOD_RES (556)..(556): Any amino acid
  MOD_RES (599)..(599): Any amino acid
  MOD_RES (621)..(621): Any amino acid
  MOD_RES (647)..(647): Any amino acid
  MOD_RES (650)..(650): Any amino acid
  MOD_RES (664)..(664): Any amino acid
  MOD_RES (691)..(691): Any amino acid
  MOD_RES (694)..(694): Any amino acid
  MOD_RES (701)..(701): Any amino acid
  MOD_RES (716)..(716): Any amino acid
  MOD_RES (719)..(720): Any amino acid
  MOD_RES (724)..(724): Any amino acid
  MOD_RES (736)..(736): Any amino acid
  MOD_RES (743)..(743): Any amino acid
  MOD_RES (752)..(752): Any amino acid
  MOD_RES (762)..(762): Any amino acid
  MOD_RES (773)..(773): Any amino acid
  MOD_RES (775)..(775): Any amino acid
  MOD_RES (782)..(782): Any amino acid
  MOD_RES (785)..(785): Any amino acid
  MOD_RES (789)..(789): Any amino acid
  MOD_RES (804)..(804): Any amino acid
  MOD_RES (817)..(817): Any amino acid
  MOD_RES (820)..(820): Any amino acid
  MOD_RES (836)..(837): Any amino acid
  MOD_RES (841)..(841): Any amino acid
  MOD_RES (873)..(873): Any amino acid
  MOD_RES (876)..(876): Any amino acid
  MOD_RES (880)..(880): Any amino acid
  MOD_RES (890)..(890): Any amino acid
  MOD_RES (895)..(896): Any amino acid
VPPGAEARGRYHHPRXEXARQGEPPSXRVFLVXLPDSNPPCPICGDHVXXXSVLALHCVEGHXWAXVQYQCTHCGILCHIPRCQGRVXEXTGKDXXCPECPASFDEKAGLSQHKRHTVTXSXERVAGXLLRAXLRHGCWSVEEEETLTRLDAMFXGARNINQLIAAEXVSKMXKQISDKWRXLXLXPEQTTXGGXAESASVVXXESMTPEMEAQSPAXPPGKIRKIFTGQDGHAGGXAWENQEDFHWTRWARRWLKRGQXLSDKVQEVLGXWVEGQPRIXAWVDXVSLDVLTLFLGVPPGPQRAPSKKGPXEGGKPTSWMNKRAIKWGTFLRYQHLFGANRKLLAAXILDGAXRNQXTLLLEEVXQXYXGKWEAEPPFEGLGRFGXXRDVDSFAFEALITXEEAVKHMMXMAXXSAPGPDKLTLRDLRRADPEGDALAELFSLWXITGVVPDRLKEXQXVLIPKAVDFEKLRQLGNWRPITIXSIVLQLXSRVLTARLTAACPIXPHQQGFISAPXCAENLKXPELIXRKVKXDRRPLGVAFVDXARAFDSVSHDXISWVLKAKGVDQHIVNLIEDSYQKVTMRVQVFSGSTPPISIKXGVKQGDPMSPLLFNIAMDPLIXKLKTVRQGVKVGSASLTTLAFADGLXLLXDSWEGMQHNITTSXTPGRACNTTSRHPRGLLQPHGPTSATXKMXGVLLESXMRLLYGEQLRGLEDXRPXXHDAXARRADTISGLEXRSLGWDXQTRFGYATXLLAREDGDCXAQTNAEALCWXSXPFPGCAXRPXYANXGWVASEALDSMSRRXVKEWFHLPACTDXLLXSRHRDGGLGLLRLARXXLAAXVRRPIRVATSSDEVTRKVSYACGISDEVERLXLAXGGDXSNVPRFEDPXAPKSXXVQGPHEAAQETPRVVRTQAIPWPSNWRAEEHSKWAQLSCQGERVELFCNDPVSNGWINSRGQLAERLWIMALKLRSNIYPTREFLGRGQAGTNIGCRHCTHPRETLGHILGICPAMQEARILRHNKLCKILAAEGKNCEWTVYYEPHLHNAAGELRKPDLIFVRDGTALVVDITVWYEGGPATLLSTTAEKATKYLDLNTQIQELTGAEQVTYFGFPIGARGKWHADNWRVLSELGLSNSRKERVTRLLSWRALLGSVDMVNIFVSKHRQENLLDEHCTPAEQVVSSYAS

SEQ ID NO: 1456 - protein, 1055 aa, Drosophila willistoni
FERRSNSWGYRPLEPRSVGTESNNNSPRSNITITSATSRPGDQPREAIAVVNLAGEIPCAVCGRLFNTRRGLGVHMSHQHKDELDTQRQREDVKLRWSEEEAWMMARKEVELEASGNLRFPNKKLAEVFTHRSSEAIKCFRKRGEYKAKLEQIRGQSTPTPEALDSITSQPRPSLLERNHQVSSSEAQPINPSEEQSNWEIMRILQGYRPVECSPRWRAQVLQTIVDRAQAVGKETTLQCLSNYLLEVFPLPNEPHTIGRSNLRRPRTRRQLRQQEYAQVQRRWDKNTGRCIKSLLDGTDESVMPNQEIMEPYWKQVMTNPSTCSCDNTRFRMEHSLETVWSAITPRDLRENKLKLSSAPGPDGITPRTARSVPLGIMLRIMNLILWCGKIPFSTRLARTIFIPKTVTANRPQDFRPITVPSVLVRQLNAVLASRLASKVNWDPRQRGFLPTDGCADNATLVDLILREHHKRWKSCYLATVDVSKAFDSVSHQAIIKTLQAYGAPTNFVSFIEEQYKGGGTSLNGAGWSSEVFIPARGVKQGDPLSPLLFNLIIDRLLRSYPREIGAKVGNTMTSAAAFADDLVLFAETPMGLQTLLDTTVGFLASVGLSLNADKCFTVSIKGQAKQKCTVVERRSFCVGERECPSLKRTEEWKYLGIRFTADGRARYSPADDLGPKLLRLTRAPLKPQQKLFALRTVLIPQLYHQLTLGSVMIGVLRKCDRLVRQFVRRWLDLPLDVPVAYFHAPHTCGGLGIPSIRWIAPMLRLKRLSNIKWPHLEQSEVASSFIDDELQRARDRLKAENVQLCSRPEIDSYFANRLYMSVDGCGLREAGHYGPQHGWVSQPTRLLTGKEYLHGVKLRINALPSKSRTTRGRHELERRCRAGCDAPETTNHILQKCYRTHGRRVARHNSVVNAVKRGLERKGCVVHVEPSLQCDSGLNKPDLVGIRQNHIYVIDVQVVTDGHSLDQAHQRKVERYDRADIRSQMRRFFGATGEIEFHSVTLNWRGIWSGQSVKRLIAKDLLIAEDTKLISVRAVNGGVTSFKYFMYCAGYTRS

SEQ ID NO: 1457 - protein, 1222 aa, Gavialis gangeticus
  MOD_RES (1109)..(1109): Any amino acid
  MOD_RES (1124)..(1124): Any amino acid
  MOD_RES (1139)..(1139): Any amino acid
  MOD_RES (1170)..(1170): Any amino acid
  MOD_RES (1191)..(1191): Any amino acid
  MOD_RES (1217)..(1217): Any amino acid
PAAPRAWGAVEAGPWPGRTRAVEPAPSPESSPSEAARAAPAGEGHGPGHESPSVQRPEADTTAPGVSAPTREGEPPSTRVFLVRLPDSNPPCPICRDHVGKPSALALHCVESHAWADVQYQCTHCKKVSANKHSILCHIPCCQGRVPEWTGKDWACPECPASFNKKVGLSQHKRHVHPVTRNVERVAGSLSRAGLRPQTRRGCWSVEEEETLTCLDAMFRGARNINQLIAAEMVTKMPKQISDKRRQLGLCPEQTTLGGDAESTSVVEEESMTPEMETQSPINPPGKIRKILAQRARRWLKKGQGLSDKVREVLGAWVEGQPRIHAWVDSVSLDVLTLFLGVPSGPQRAPNKKRPKEGGKPTSWMNKCAVKWGTFLRYQHLFGANRKLLVAIVLDGADRNQCTLLLEEVFQAYREKWGLEEVLRAYRGKWEVESSFEGLGRFGVRRDADNFAFKALITPEEVVKHMMAMASKSAPGPDKLTLRDLRRADPEGDALAELFSLWLITGTVPDGLKECRSVLIPKTVDREKLGQLGNWRPITIGSIVLRLFSRVLTARLAAACPINPRQRGFIAAPGCAENLKVLELLLRKRKRDRQPLGVVFVDLARAFDSVSHDHISWVLKAKGVDEHIVNLIEDSYQKVTTRVQVFNGVTPPISIKTGVKQGDPMSPLLFNIAMDPLIAKLETDGQGVKVGSASLTTLAFADDLVLLSDSWEGMLKNISILEDFCNLTGLRVQPKKCQGFFLNPTCDSFTVNNCEAWKIAGREITMLGPGESTRYLGLNVGPWVGIDKPDLGTQLSSWLERIGTAPLKPMQKLSLLVQYAIPRLNYQADYAGIGRVALEALDSMNRRKVKEWFHLPACTSDGLLHSRHRDGGLGLPRLAKAIPEAQVRRLIRVATSSDEVTRKVSYACGISDEVERLWLARGGDMSSVPRFEDPEAPRSPGVQGPCEAAQEIPSVVRKLAIPRPSNWRSKKHSKWAQLSCQGEGMELFCNDPVSNGWNNSRGQLAEHLQIVALKLRSNIYPTREFLGRSQASTNVGCRHCTHPHETLGHILGICPAVQEARIIRHNKLCKILAAEGKKCEWTVYYELQLLNAAGELCKPDLIFVRDGTXLVVNVTVGYEGGPAXLLSTAAEKATKYLDXNAQIQELTGAEQVTYFGFPIGARGKWHADNXRVLSELGLSNSRKERVARLLXWRALLGSVDMVNIFASKHRQENLSDXALSPS

SEQ ID NO: 1458 - protein, 1247 aa, Ixodes scapularis
MQCTSRLADAPRFARVGVEGEGVGASGNGTDAQLWYGCTGCDEAFSSLRGLRIHAAQKKHGNQDGLLRLPAGRPRKRRVGKSTTAGASDRVTTDPVPAPVPESPGLLPGLPGPSLPGCSDLPPGVLPGGWSASPGPLSWPPSLDAGPLPGPSRVSPGPSRPSPGKPTGPPSLDAGPLPGPSRVSPGPSRPSPGKPPGTPEPLPGSPGGRRGVSPGQPGSRTDPSSSAGAGHFVCPQCSRAFSSKIGMSQHQKHAHLEEYNAGINITRTKARWDPEETYLLARLEATLNPDHKNINQTLHAALPRGSCRTLESIKAHRKQAAYRDLVTSLRSARESSEAQHVPDRPLETPEPQTPANPQRDSKQAVIEALQSLIGRAPPGSFQGARLWDIARQATRGTNILPLLNSYLRDVFTLPTKPTRKKPAVRPARSRRKQKKQEYARTQDLFRKKQSDCARAVLDGPTSSSVPGTGAFLQTWREIMTGPSPALEAPPLPTRGEVDLFFPATAQEIQSAEIAVNSAAGPDGFSARLLKSVPALLLRVMVNLLLLVRRVPAALRDARTTFIPKVPDAVDPSQFRPITVASVLQRLLHRILAKRALEAIPLNFRQRAFQPVDGCAENIWLLSTALNEARTRRRPLHMASVDLTKAFDRVTTDAILRGARRAGLSGEFIGYLKELYTTSRTLLQFQGESLLVEPTTGVRQGDPLSPILFNLVLDEYLSSLDPDISFVSGDLRLDAMAFADDLIVFASTPAGLQDRLDALVEFFDPRGLRVNVKKSFTLSLQPGRDKKVKVVCDQIFTIGGTPLPASKVATPWRYLGMTFTPQGSINKGTSEQLDLLLTRTSKAPLKPQQRLVVLRNYLLPRLYHRLVLGPWSAALLLKMDTTIRGAIRRWMDLPHDTPLGFFHAPVTEGGLGINSLRASIPAMVLQRLDGLHFSTHPGAEVAIQLPFLTGLHRRAEAAAQYQGQRLLSKADVHRMWSARLHGSCDGRPLRESKRVPAAHRWAAEGTRLLSGRDFISITKLKINALPTLERTSRGQHKDIQCRAGCQAVESLGHVLQACHRGHRGRIRRHDNIARYVCGRLTQIGWAVKWEPHYSVAGRTLKPDIVAHRGAETVVLDAQVVGTSMRLGFHHAQKKEKYSLPDLLHQVCEGRRDAARVSTITLNFRGVWAPESAQDLKSLGLTDNDLKLLTVRCLQGGAQCFRLHRRMTTVVKATGDEANALPAHSGLPPTQLGGRTLGPSAHNQSARTT

SEQ ID NO: 1459 - protein, 1099 aa, Mnemiopsis leidyi
MSNTSHSKLNLKMDNKLKTSLETPSGVRADSIITRVRTSSNRGEHSNGVTYPRCEQGVAPLDTHGGICDAPPQVTVPATETDKQKKCEYCEFTYLKPRQIGTHMRKRHPQEWNDIKRTKFLSEKRQKRWLDEDFELLCIGQEEYLVLSSIGKQGKGINQYIQTKYFPTLSTDAIKSQRKSRRFSEYSEKRSRELQPCNTSSDPEELPNEAVTENSPLSFDPLDRDVVKKISSKDHGDQILLVQEHLINGRYQEANTLAKAIFEKLSGKFPNLKTGDHRPGKQQTARKVGKKRVRGSGKKLSPSKQNRRELYAIVQKQWRTKKRSKVINQILTGNLNKEQSYTHTPDQLAQFWSTLFGRVSPRDDRPINHRRSVIPELDKPLSVEEVEAALKGAKDAATGIDGVPISHLKHLGSAALTILYNGLYVTGSIPDPWKRARTILIPKSNPPASPGDYRPISISSYFYRIYTSAISKRLASAVSLDDRQKGFIKEDGIRDNLSLIDTLINETKAGSKSLFMTFMDVKKAFDSVSHYAIARSLEWAGVPDGMRSVIADLYQDCTTDICGRSVKVTRGVKQGDPLSSTLFNLVIEMVMSNVPERLGIQFQGHRLFYLAFADDLVLLTRGPTANQKLVSLVHEQLARVGLELHPGKCKSIAIMADPKRKTTFVDQGSSVLIGGEPVSSLGPQEWYKYLGIKLGSGGMPQGIYRDQLADLLAKTDSAPLKPQQRLYILRSHILPKFNHRLMFERVTCQTLEGLDKLIRTHVRKWLKLPKDTPGPAFYADKGSGGLGLITLRYRVPLLKLRRHKKMADSPDPVIRLIPNAEPTISLLARWTKMCSLYGKQYQHKSELSKIIRDKYWTMCDGKGLRTEVPPDTAKKTLSLLFEDRTPLKPGQLIGAIGVRLNTLGTPARNNRAKGYSPEANICDKCPGNRQATLGHISQTCPATHGRRVKRHDKIVNRIAKALKERGSVKNILTEPHLRHDKLPLRKPDLIVHTEKSVEIIDVQVVADQGISRHEDEDQQKKIVKYDVDGYKRAAYKMLGIDYGSIPCNVSAFTITWRGNLAPHSLKLASRLQFSPVLKYIVADSLVDTWGAFLIWGKTS

SEQ ID NO: 1460 - protein, 1085 aa, Petromyzon marinus
MNERLTDELTTEFILSDMFLWDYPCTDQNKCYPCNLVFLDHRTWSSHMARVHPHANKTYKCRICNRTADSIHKIASHYGRTCKSLIGKTNAITTTIDETLFSCLHCSRGFTTKTGLGVHTRRTHPTEHEAILQQNTPGRKVRWGEEEVEIMAHKEAQQKDEDINMNQLIQNSVMPHRTLEAIKGKRRNIKYKELVRTLKETTYKVENQCLVNLVLPTTSEITTTPSEGDQPAIRAEKEQSPTAAEDLQVIINDLKSQNFSHNQALLLLNSHVEKFLNRSKPIKRKDHVNQQEIDENRHRRQSKQTKYRRYQYLYHTNKKALLDEITSDRSGPSIYPTEESIRGTFVTLFESNSPPDNIPSKLKNDQSCIDIVKAITLDELIKTLAIMKDKSPGQDNITLSDLRTLPIKYLLDILNIILYIQDIPQIWKQHRTRLIPKTKEELEKPSNWRPITISSIVIRLLHKILSYRLGQQLKLNYRQKAFLPVDGCFENSALLHFIIHNARQKHENTQIVSIDLSKAFDSVSHESIIRALNRFNLSKESITYLTNIYKCNLTDIVFGSTIMRNINLKRGVKQGDPLSPLLFNMIMDELLDNLPTYIGVNVGNQKVNSMMFADDLILFAETECGMNKLLDITTKFLDDRHLKININKCNSLRFIKYGKQKTFSVATTSSYFINNEPINPVSYVKGFKYLGIEFDPRGKRSISCNLLAAMLNKLTRAPLKPEKKVYLINNNLIPRIIHQLVLGKVTKGLLMSLDSEIRKTVKLLLRLPHDTPDSFFYTSVSNGGMGIRNLCDSVALSIINRHNKLITSDDLVIRALSQQSYTIATLKQAHIIAGSKFPSKSLNQNKWSNKLYQTTDGRGLVYCQSQTENNSWITGNHRTIKSYNYIDMVKLRINALPTKSRCNRGTLETKQCRFKCRSINNQISEETLAHILQKCDRSHYSRIARHDSLVQFLATAAQKLNWEVIKEPTLPSDTNKAKPDLILVRDSHVLIVDVAVPWESRSLAHAYDFKVKKYATDKKMQAYLKTIYPEKEIRTEALIISARGGWCALNNMVTKKVGLSSAWVKLALIKVMEGSVKIWRSWSKG

SEQ ID NO: 1461 - protein, 1031 aa, Schmidtea mediterranea
  MOD_RES (78)..(78): Any amino acid
  MOD_RES (87)..(87): Any amino acid
  MOD_RES (200)..(200): Any amino acid
MKKVLNNETEKLPGSNLTFMCGFCDREFDTARGRGVHESRGHLVERDAAVQSRVKAVVSKKYYYSNEEDVALAKMQLXHADLAKSEXLEAMYLALGKGRTREAIEQHIRKSLRYKGVLEEQRKLLETARGNVRQNNVGVPASNATKNLQRFLESLPLGTNRREERLDRIIRSNSIESQRLELIHYCNDMCQDFVQLDCQXNPINAIRRRNPKRLSKKQLKRAKFSALQRLWIRDRKAAAQLVLKDKLDSLLSNKEDSKDLGSYWQQVFERESELDRRPIPQVVENEELNSPVLEKEVEWAVKNIKKSTAAGPDGLTALALKKIPYSELVKLFNIILLVGFLPDVLKNSRTILIPEVDNPQGGGDYRPISINSVLTRTLNKILAKRVSEGDFGINGQKGFKSVDGCLENLATVESILADARMKKNKLAVVFLDMSKAFDSVNHESIVRAGEIKGYPKLLMTYVKECYNDATTNVAGVTAKFNRGVKQGDPLSPALFNNVIDLAIERVSGTGIGYNMGGKKYSVVAYADDLVLFGESREGLQIALTALLEELKLNGLTPNPAKSASLTFERSGPHWFASTDTVTALGDQIPAMGNIETYKYLGIKFNSCGVVKGSLPGIYTKKLELISKAPLKPQQRLAMLTDFLIPGVLHQAVFGQTNAGDLRSLDKRTRRAVRSWCHLPSDTSTAFIHAKAKDGGMGIPSIRAEVQFGKLDRFGKLPNVKDERSKVLADNAHIKKKMLEKLGVGIPIKGVRCKNKLEFYNKMREELIKSNDGIGLKEASLVPSANTWLKLSDLHMSGRTFVGCLKTRGNLMATVTRTSRGGQNPGIELNCKKGCQYQGSLNHIVQKCPVVKGLRIKRHDEVVKYVEEITKKAGWSATMEPIIPFEGSHRKPDLVLVRGDLGKVVDIQIVSDHCGLDEKNSCKIGKYDNDIIRNYVRGLGPSRVEVAAITLNWRGVWSRDSFNLIKRLGMTEMDAKIISMRVLASTAKMFKTCKKVLEPVCRTKTADCDGYGPEETSARPCHELNLKESSGT

SEQ ID NO: 1462 - protein, 1395 aa, Strongylocentrotus purpuratus
MENSFAWEGTSSAEGRTTVEDSPSSSDDFVSNVGFKVAKADPTVWEEANMSEDNTIIEDPPSSSDDFANNVGFKVTRADPTAWEEASTSTETEDLPSSSNFIDNVETQIDMAGPTAWEDADSNEDNIDEGTPNNINNNLAIVRGRADAYACSCCERNFISLKAIGTHLKETHNKKVVFECAKCQHTFVKAHGLACHVPKCKEDADTPMLNRLLHGCGECGLAFNTRRGLSQHERHRHPSACLSTRRRSRLDGIARKKSLRNRRDIWTNDEIRLLKQLMIQYEHAKKINIKIAEHFNHKNAKQVMHKRRSLREKDMALGAPHDAPPPLAEEPIIEVVEGAREELEQAPVDVILPDLEALTVNDGRGGGSPVLTEGGESTRDMEENGGTDTRSPSPREERAGSTPWERGWQPRVDRGRGEYKGYGGERGDRHTVSLSQRGESGVDPLTPGGVVEDYDDSYLEDYFPGWDEDEHMHIIGRLDLSDESEQGEAAVSPRLGSFGDLLEEVNAMEGKDNLSEALAETLGLVLHEGHRVEYIKEKMNINVKQMATEILAHGANKGNPKRRKEAVAAKRNPGTRLDRAQRDNQAKAKAKEKKRIFSETQTQYKKNPHRLVEKLLDGKGDERCSVSLEVIQRTYMNRFSRESKEVDIGAYVDPETVEDNQGIVDPISKAEIERAISTTKKGSAPGPDGVTYDALKAYGNCQLYLLIMYNTWLAMGKVPSEAKTYRSILIPKGQGDPMDINNFRPLTLANVISRLYSKILTRRLDGAVSVCPRQRGFTHKASIEDNTLILRELIMKSKRNKECLAVVLLDLAKAFDTVSHDLIIKALRRHRVHEHLISVIMDLYEGGTTSFTTDEGTTCPIAIRSEVKQGDSLSPVLFNLALDPLLATLEQRGKGVEIGGHTFVSLAYADDTALVSSSHLDMTANLDITVEYLNATGLSLNVRKCQGFLLTPINKSFLVNEAESWVVEREAIPWVEPGDTAKYLGVQVGPWSRPWPSIQPVIKRLTAYCESIDKAALKPRQRIHILTTYIAPRIAFEIAEGGYSTLVDCRGGIQYTRIREVDMTIRNYVRKWLFLPACLSNSFLYTRRGEGGLGLVSFYDYVPTERMRKLVRVCDSEDPVIAGAAASLGLRERAAKISAQTGLPVPVKPKGAHNAWRKVQKKKWKAQPTQGKGVSCYQHRLGNKWLGAPSFLTENDYIWAIKLRTNLVPTREAMGRGIIGRNQVECRHCHTTIETMGHISGYCQMVLDIRLIRHNRICKALIKAATATGLRVTEEPRIVGTDGKNYLPDLIFSAGAGEPCYVVDPTVVWDDDPKNLREAWRGKVRKYTPIIPAVEAMLHPSSVQIFGFVCGARGTWCPMNDDIAKIVGLKNSGISRTLQIVLCDTIRMVKAFMAR

SEQ ID NO: 1463 - protein, 1236 aa, Salmo salar
MSGKRIVEMSGCDEKICQNKHCLKRRWAWISGPKGETSPPRKRGTCENVSFQDKSHASDPDPLKAPEAREDAGSVAPQWVGEIKTPSLTSRDGVSEVVLPPQPVHAEGVSPASDSKDKATKITLLISLPVCDLRCGRCERPLETVGKAVRHFAVAHPTVSVVFKCQKCEKSSKNSHSISCHIPKCKGMTETRTDVEGDHGCDHCQEKFTTAMGLTQHKRHRHIVQYCKEKEGEMTARRKGEVEAVKWSEWEESEVARLSDGLAGLKMINRRIADSLGTGKTAEQVRQKRRRMRPEKVRCDKPKEAKDKSNLIKMLSIPSATPTPQTGLKGFLLGELNGVATKGEVQIGGVTLSLRGVEQDSALLNTSALELQRLLGGRAGSANPLSLQRERETTLPSERRKTKQGEYRRVQKMFRSNEKKIAKYILDGNGDGEAASPPLEIALAFKSRWEEVETFHGLGQFYSRGEADGVVFRSLISMSEVCENLGAIKNNTAAGPDGITKPALLEWDPTGAKLAAIFSIWLTSGTLPGPFKKCRTTLIPKTDDPILLTQVAGWRPLTIGSVVLRLYSRILTHRLERACPINPRQRGFISSPGCSENLMILGGLIKRSWAKGERLAVVLVDFARAFDSVSHSHILEILRQRGLDEHIIGIVGDSYTDVTTTITVSGEQSPPIDMRVGVKQGDPMSPLLFNLALDPMIDTLERYGLGYRMGEQQITALAFADDLVLVSDSWEGMACNIRILEEFCRLTGLRIQPRKCHGFLIQKIQRARSVNLCKPWIVCGEELHMVGPEESVSYLGMKVSPWHGIMEPDPVERLCNWISSIGRSPLKPSQKVRMLNVYAAPRMTYQADHGGLGPIVLNVLDGMIRKAVKVWLHLPLCTCDGLLYSRCQDGGLGIVKLACQIPSIQARRVYRLWHSKEAITRVVTRRTVEAEEYRGMWLRAGGSEAGLPPLEDREEGAVQCTDTAGSVKPKNPVIPDWRRAEFLKWQNLTAQGVGVQVFGGDKNSNHWMANPETLGSKERHYIAGLQLRANVYPTREALSRGRPDLPKVCRQCLAGTESCAHILGQCPAVKDSRIRRHHKLCDLLASEAESAGWTVIREMCCRTRAGALRRPDLVFVKTGFALVVDVTVRYEMAYDTLMGAAAEKVARYTPITPYVAMTLKARRVKVFGFPLGARGKWPGSNDRLLKAMGVGGGRRKQLAKLFSRRALLYSLDVLRDFYRAEGETGDLDDESVDDHL

SEQ ID NO: 1464 - protein, 1298 aa, Tribolium castaneum
  MOD_RES (129)..(129): Any amino acid
  MOD_RES (184)..(184): Any amino acid
  MOD_RES (218)..(218): Any amino acid
  MOD_RES (259)..(259): Any amino acid
  MOD_RES (369)..(370): Any amino acid
  MOD_RES (402)..(402): Any amino acid
  MOD_RES (721)..(721): Any amino acid
MSRRPGKSNEPPVRSRAMGLTTLSGTKTSNSGAQGPSTSAPMQNMAGGFVCDCGRSYALKTSLARHKKECGKNNAECRWCGTRFNTLAGTRQHERKAHFVQYQSDLAKALPQPESELMEKIAIVEARSXNGIFYKEMMASTGLTHQQVRSRREKPEYKGFLERARRSLAQTNIRAGSISPASTXAGSLESASPKAGCSSSASPGPTTRSRAPTKGVPXRSSNSARIVVEAQVHTRAPPNTGETEVALRESRRTVPRLGXNPSRPCGISPLMAIAIDEDSVLGGLRVQAGPSPTAVHSVEAFPGTSSMTPMETDRVHNKSGIDPILEHNGTRQVRREESSTREDPVEQWSPNYPKTPVTMPNITTTADAXXTSYNRTPQTLPGNRRRRSRSLPPVQRKSASDXLESVDSLGPWAVFLQDQVDAGSLSGNDSLADLVRVALTKSDRGVLNDAVNRYLAQRAESLRIRKRGSKGKRKSKTGRHYGQTTSGSGQRAALFKKHQDLFLKNRRGLAETILSGKEDFGPRPEPPVTSVEEFYGGIFESPSPPDNEPFEVRATGVEDPPPLTSPWTKRTLRSPCYWRRRPPPTYITMDEIKAARAGWQISAPGSDQIPVAAVKTMSELELAILFNIILFRNVQPSAWGVLRTTLVPKDGDLRNPANWRPITISSALQRLLHRVLAARLSKLVSLSSSQRGFTEIDGTLANALILHEYLQYRRQTGRTYXVVSLDVRKAFDTVSHCSVSRALGRFGIPSVIREYILATFGAQTTIKCGSVTTRPIRMLRGVRQGDPLSPVLFNLVMDELLEKVNEKYEGGSLQSGERCAIMAFADDLILIADRDQDVPAMFDDVSTFLERRGMSVNPAKCRALIAGAVSGRSVVRTGSSYKIHNTPIPNVDALDAFKYLGLEFGHKGVERPTIHNLSVWLNNLRRAPLKPDQKCLFIRQYVIPRLLYGMQNPQVTSRVLREADRLIRRHLKTYYHLNVHTPDSLIHASVSDGGLGIMELRKAIPRIFLGRLVKLLNKNKDSVLSSVLQSNRVRTLMGKLSTMAGEVPESTFWRNQIASGPLSKGLEQAAEDSASRLWISEKPSGWSGRDHVRAVQLRTGNLPTKAIPSVPVGQRRCRHGCACDESISHVLQMCPLTHADRIRRHDEVVKKVARHCTSRGWTVEVEPHIRSRCGRLFKPDLAVHQPGGAIVIADVQVSWDSESLTVPYERKRAKYDVPQFHQAAQHAWPGKALTFAPVIVGARGIWPRINNDRSAALQIPPVVRRACVNSVVKWGSSIHATFMRSVWANRLNPRPLRA

SEQ ID NO: 1465 - protein, 1243 aa, Tinamus guttatus
  MOD_RES (40)..(40): Any amino acid
  MOD_RES (71)..(71): Any amino acid
  MOD_RES (84)..(84): Any amino acid
  MOD_RES (347)..(347): Any amino acid
  MOD_RES (495)..(495): Any amino acid
  MOD_RES (503)..(503): Any amino acid
  MOD_RES (572)..(572): Any amino acid
  MOD_RES (724)..(724): Any amino acid
MGSWIVNFVSVATQTGEFPVDTARRAPVPVTSYPESECHXPLPLTFCNSDVTIWGGVRPEPVDCLGDLPEXYDALPGVAGPREXVGGSPPGEGVRSPGIASPSGTAVQHDFGSPILVPGAEAAEVSTPVVKVPQDHPACPCCGTRVVKVTALSEHLRRAHGRKRVLFQCSRCGRMNEKHHSIACHFPKCRGPPVEEGPLGAPEWCCEECGQKFNTKSGLSQHKRSVHPLTRNVERIEAARPKGKGKRGAHKGCWTEAEVAQLIELEGRFKNQRFINKLIAEHLPSKSAKQISDKRRQLAAATKTSSPEKRVTSSTSGESSPEVEKVEGIKREYRRRVGEWLCAGSLXDQTSFQKILEDVESGSEIVTGPLEELASFARGKLAAARVRHHRKHPAEAVPAREEQRWMKRRVGRRGLYLRFQRLFALDRRKLAGIILDDVESIKCPLPMEEVADVFRRRWEEVAPFTGSGSFRSLGKADNGAFKPMISAKEVMKNVXEMSRRSAXGPDGLSLRDLMKIDPQGSRMAELFNLWLLAGRVPDQVKAGRTVLIPKSADPGKIGNIDNWRPITIGSVXLRMFSRILSARLRRACPINRRQRGFIAAPGCSENLKLLQALIKSAKRDHRTLGVVFVDLAKAFDSVNHQHIFQVLVQKGVDGHIIDILRDLYTNAGTYLESGSQRSGFIKILRGVKQGDPLSPILFNLALDPLLCRLEDRGLGYKYGDQQIXSLAFADDLALLSDSWEGMQQSIRVVEEFCQRTGLRVQAPKCHGFLIRPTKESYTINDCDPWTIADMQLDMIDPGSSEKYLGLGIDPWIGLSRPELSEVLTRWVKNIGGAPLKPLQKVDILRSYALPRLLFIADHAGLSATCLHSLDLSIRSAVKGWLHLPPSTCDAIIYVSYKDGGLGLPRLASLIPNVQARRLVRIAQSEDDVIRSVVLQEGIQEEIRKVWISAGGRPEKVPSVTGEFPVMEAQAADEALSEWERRAPRTIYPIPCKWRKREMENWTNLKSQGHGIRNFENDRISNDWLLHYGRIPHRKLITAIQLRANVYPTREFLARGLGEGAPRGCRHCPAEWESCSHIIGYCPAVQEARIKRHNDICGVLAEEARKLGWVIFIEPHLRDNTNELFKPDLVLVKGSCAKVVDVTIRYESGLTTLSDAAAEKARKYQHLAGEVRALTSATTVDFLGFPIGARGKWYVGNNGLLSDLGFSTSRVVRIARALSKKALLSSVDIIHIFASRARQAQTSE

SEQ ID NO: 1466 - protein, 1085 aa, Trichinella spiralis
MSNRLANTAAAGGVPEKTSGTLDIPGQPSSSGEKRAISYPGPFGCNSCSFTSTTWLSLELHFKSVHNIRDFVFLCSKCKKSWPSINSVASHYPRCKGSVKAAVVPTSLANTCTTCGSSFGTFSGLQLHRKRAHPDVFAASCSKKTKARWSNDEFTLLARLEAGLDPACKNINQVLAERLMEYNITRGVEMIKGQRRKDQYKALVRQLRSNSETQQCVGLAGSMDSNVPANDTSSSVASEVSITYPEYGAVMSCDLIKEATGMAIVDINELQSNLRKAFLSGRKLPMKFHGARETAQKKMANPRVAKFKRFQRLFRSNRRKLASHIFDKASLEQFGGSIDEASDHLEKFLSRPRLESDSYSVISGDKSIGVAHPILAEEVELELKASRPTAVGPDGIALEDIKKLNTYDIASLFNLWLKAGDLPASVKASRTIFLPKSDGTTDISNCRPITIASAMYRLFSRIITRRLAARLELNVRQKAFRPEMNGVFENSAILYALIKDAKVRSREICVTTLDLAKAFDTVPHSRILRALRKNNVDPESVDLISKMLTGTTYAEIKGLQGKLIPIRNGVRQGDPLSPLLFSLFIDEIIGRLQACGPAYDFHGEKICILAFADDLTLVADSAAGMKILLKAACDFLEESGMSLNAEKCRTLCITRSPRSRKTFVNPAAKFIISDWKTGISSEIPSLCATDTFRFLGHTFDGEGKIHIDTEEIRSMLKSVKSAPLKPEQKVALIRSHLLPRLQFLFSTAEADSRKAWLIDSIIRGCVKEILHSVKAGMCTDIFYIPSRDGGMGFTSLGEFSLFSRQKALAKMAGSSDPLSKRVAEFFIERWNIARDPKVIEAARRVYQKKRYQRFFQTYQSGGWNEFSGNTIGNAWLTNGRARGRNFIMAVKFRSNTAATRAENLRGRPGTKECRFCKSATETLAHICQRCPANHGLVIQRHDAVVTFLGEVARKEGYQVMIEPKVSTPVGALKPDLLLIKADTAFIVDVGIAWEGGRPLKLVNKMKCDKYKTAIPAILETFHVGHAETYGVILGSRGCWLKSNDKALASIGLNITRKMKEHLSWLTFEIIFITQISRIYNSFMKK

SEQ ID NO: 1467 - protein, 1086 aa, Tetranychus urticae
MCILGGLTSHSREGGLSRGSSQLKTVKPQNEEDNGTTQLKAGSADSFPRPSGDLNPEEPLSIDICPVCFRQMKSYLGVRVHMQKMHLEEYNASIPDPVVSHTRWSDEEAAQLAFTEAKIEVDKLLPRGKGINKFLLELLPGRTLESIKSHRKRQSHKDLVRKYVKEFVDTLAADNDDDTIICQDNGDIFNDPIVGATDSQSETETVADPAEFKTFIELADDPTKPKVVAKLRNLIKDKPKSEILGSDILVRILRRTLHGLPVEDELDQYLEVYFTGKIKQRRSKTQTALSKKQIKQRDYGRLQELYSRSRKRCANEILNPTSMSGGFGHQELSEFWTKTFGPDEQPTLGEVEIIPKENCWWDIFSPISSDEIKASYPSIGKAAGPDNFSAYQLRKVPVWHLECLYNIFAFYKDIPSRLKDAKTILIPKKDNAESPGDFRPITLSSIITRHFHKILATRVNNFVRFHPMQRGFIQSDGCLENTALIQTVIREAKVRRKQVHITFCDVRKAFDSVRYDSIIAAIAKKGAPGSFIMYLSNLYRGNKTTLLTAGGETRITPTRGVRQGDPLSPILFNCVMDQILTALPSRTGFTLSAGDESVNVNCLAFADDIILISKTKNGHQELLDVTQRILKENGLDLNPDKCCSLSLIPHSKTKKIKVVRADFVVNGVKVRSMSIGDSTCYLGVSINVTGQVAPVKMYQALCEKLDSAAIKPHQRLYILKHFVITKMFHPLILSTIAAHKIKNLDLISRRYVRKWLHLPHDCGSGMIHAKVSDGGLGVPLLFRTIADLKVRRKEKLQVHENPIFRILAKLSTVSKELENCKKIASKTTDIQEKTFKEMLATYDGLSLKEARAVPEVHKWVDSYDKRYKFAGRDFVQVIQARFNALPTRSRVWRGRGADEKSLRCRAGCNARETLNHVSQSCFRTHRVRTARHDKILDFICERLDVVGVKYVREKPISFPGKKLIPDLIVENTDQALVLDLQIVGDNSELPLDERGKNKVIKYNCSEMQELYKRKKKTLAVKALTLHYKGLMAPETSNILRSFGFKSKDLEKMAYMALFGTVAAWGIFNRSTETMRSVANWPRPEEL

SEQ ID NO: 1468 - protein, 1054 aa, Drosophila willistoni
FERRSNSWGYQNLEPSNVGQDMNTVPRINNTTTTPATSRPGDQPREAIAVVNLAGEIPCAVCGRLFNTRRGFGVHMSHQHKDELDTQRQREDVKLRWSEEEAWMMARKEVELEASGNLRFPNKKLAEVFTHRSSEAIKCFRKRGEYKAKLEQIRGQSTPTPEALDSITSQPRPSLLERNHQVSSSEAQPINPSEEQSNWEIMRILQGYRPVECSPRWRAQVLQTIVDRAQAVGKETTLQCLSNYLLEVFPLPNEPHTIGRSNLRRPRTRRQLRQQEYAQVQRRWDKNTGRCIKSLLDGTDESVMPNQEIMEPYWKQVMTNPSTCSCENTRFRMEHSLETVWSAITPRDLRENKLKLSSAPGPDGITPRTARSVPLGIMLRIMNLILWCGKIPFSTRLARTIFIPKTVTANRPQDFRPITVPSVLVRQLNAVLASRLASKVNWDPRQRGFLPTDGCADNATLVDLILREHHKRWKSCYLATVDVSKAFDLVSHQAIIKTLQAYGAPTNFVSFIEEQYKGGGTSLNGAGWSSEVFIPARGVKQGDPLSPLLFNLIIDRLLRSYPREIGAKVGNTMTSAAAFADDLVLFAETPMGQTLLDTTLGFLASVGLSLNADKCFTVSIKGQAKQKCTVVERRSFCVGERECPSLKRTEEWKYLGIRFTADGRAQYSPADDLGPKLLRLTRAPLKPQQKLFAHRTVLIPQLYHQLTLGSVMIGVLGKCDRLVRQFVRRWLDLPLDVPVAYFHAPHTCGGLGIPSIRWIAPMLRLKRLSNIKWPHLEQSEVASSFIDDELQRARDRLKAENVQRCSRPEIDSYFANRLYMSVDGCGLREAGHYGPQHGWVSQPTRLLTGKEYLHGVKLRINALPSKSRTTRGRHELERRCRAGCDAPETTNHILQKCYRTHGRRVARHNSVVNAVKRGLERKGCVAHVEPSLQCDSGLNKPDLVGIRQNHIYVIDVQVVTDGHSLDQAHQRKVERYDRADIRSQMRRFFGVTGEIEFHSVTLNWRGIWSGQSVKRLIAKDLLIAEDTKLISVRAVNGGVTSFKYFMYCAGYTRS

SEQ ID NO: 1469 - protein, 1253 aa, Petromyzon marinus
RPQTKLMTDKLKFSSQLARGLAKQRAMDGARVGDPPITVRPTETDLCNTEGSWGRRPMKLLFVSVSTQTQNEDALWASDVAKPMASRSALKMTSIPSMTFHNSSLEKEEEMNYDFYEQIKSLVESDDSSDDFTEDDEDVEESFLDISAEEPVLGKFPIDTKGTITVVLPSLEYICVICKQHMGKASELVAHFNIKHRDIPLVFKCAKCDKTNSNHRSIACHAPKCGGIKLTEESLPMVCECCQARFATLSGLSQHKRHAHPVTRNEERIKDGIKGTSQRGVHRSCWSLKEVEQLALLELQFQGKKNINKIIAEALGTKTNKQVSDKRRDLSKKTGAPMSDSLHFSSRPLETLSPPPNVTTGTSSILAQAAERLTNENSGTLEKPAMEAIKAWLNGEGQHDALVETATALMLCPMRLVKNKGKRSKPENDIIKPRILPTRSWMKKRAEKRGSFMKHQKLFFKNRSLLASLVLDGTERHECRIPNADVYRFYCEKWEKVLPFNGLGQFKSSGVANNEYFEPLISVEEVQTAIRAIKPTSAAGPDGLTRAAICAADPEGRTLTALFNAWMITGIIPKELKKNRTILIPKVMDDEKLKELGNWRPITIGSMILRLFSRIMTARLARACPLNPRQRGFIAASGCSENLKVLQDLMRHAKKLHRPLAVMFIDIAKAFDSVSHAHILWVLRHKKVDEHVVGIIQNAYDRCTTSFKSNGESTREISIRVGVKQGDPMSPLLFNLAMDPLICTLESHGVGYSIDTDHVTALAFADDLVLVSESWVGMAANLAILESFCGLSGLEVQARKCQGFMISPTKDSYTVNNCDPWTIKNKDVHMIQPDESTKYLGLKICPWTGIIRSDLHVQLKTRISKIDEAPLKPTQKVELLNAYALPRLLYPADHSDCKQSTLRVLDQEIIKAVKGWLHLPASTCDGLLYARARDGGLAILKLENAIPSVQVRRLQRIANSSDAIARNIASSQGVEEEYRSLWVRAGGDSEAIPTFFLRGSESKEPVYPRPCDWRKRESRRRCEKPVQGRGIVNFAQDRISNAWLGPRCGFKQCFFIAALQLRANIYPTRESINRGRDGASRSCRKCSARLESLSHILGQCPAVQKFKDCATQTEAEMVPHGPAGNALPGWSLSRTFLVNVPQYKNSRIARRNKISDILADEAARLGWWVYKEPRFTSEAGELRKPALVFAKGEEALVIDVTVRFELSRKTSSEAASHQVAYYTPPCDQVKVLTKASNVTFFGFQVGARGKVAP

SEQ ID NO: 1470 - protein, 1127 aa, Schmidtea mediterranea
RKELVTIKNLFEESGATAPAPVPLEVAVEVHQSSSVPEITDESTTTQEGSYSEPPIHRCENCGREFRTRAGVQQHRRKAHTNEFMEEKEKAAPTKKLRWTDEEKEILIESEIKIIKEGSLKEQHEINKILASRMPGRSQDGIAKIRQKQEHKAEIQRRLHGTVTTNETRGNRTSEITEPIRSLPINTKTWSEDEMKRMLAEEVKLRTKNEKDINKKLAEIFPNRTMGSIKSKRTKDKDYQDLVKLTMQTISENPDNETDFNTSNTENNSTDAEKEVKNYLNMLLLTINEEEWLTSTLKEAATLALQGKKTEASEKLNEYASKTLFPGLKITNQTRKREKKISKRETRRQEYAEIQKLYKKNISSAAEKAINGKWSIKPEEEYHNNKDLIKAWKPILEAPPFSDCRPIENIKEMDYALMEISTAEIFLAIRAMGKTAPGPDGIKYSKLKKNIQSMAILFNTCLLTSFLPLPLKIARTILIPKQENPGILDYRPLTIASVVTRVFHSILAKKLDNNAQLSQRQKGFRKCDGVAENIVILETILTNSRSEKRPLCMAFVDLRKAFDSVGHESIIRGAKRVGVPPMLLEYISSSYQNASTNLFGEILNSRRGVRQGDPLSPILFNFVIDEALENLNRNIGYLLKEEKVSCLAFADDIVLIAETKGGLENHIEKLLEKLNGAGLELNASKCATLMVMKNGKEKSTYISTKAIKIKENDIPTMKATETYKYLGLQMGFKAREQNANEVITEGLENITRAPLKPQQRIHILRDFLIPRLIHKLVLGRVAKKSLKRIDQNIRKKVRNWLHLPKDTTAAFIHADAGDGGLGVPALEHTIPLLKRERITNLRKSNDPVTKECLRMEYTKQVLGKWSRPTKIGETLATNKSQLKEAFRKQMLITLDGKGLKDHHETPTIHKWIRRGENMTGKQFITAVKIRGNLVATKSRNSRGRPEQEKLCEAQCGRPDSLGHILQGCWRTHGMRVERHNNICRRIKAIMKGKESEVVEEPRLQTNEGLRKPDLLICHKGKIIICDAQVVADSSNCSLESENQRKIDYYKKDSVVSEARKLIGRVDEDIIIMAVTFNWRGAISKTSIRDLDMLLDIKSKEVIKMSRKIIRDNSIMVEMHRNRTEKRR

SEQ ID NO: 1471 - protein, 1089 aa, Tribolium castaneum
  MOD_RES (546)..(546): Any amino acid
  MOD_RES (551)..(551): Any amino acid
MKSRSFRRIGDCAAGSSRRGVRLTGKAGREGRFAASPHLSPRYLAGSVSGNVPSVPPGPGLGAGAPAFAAGRNADGGPAQNPCPYCARSFTTANGRGLHIRRAHPDEANNAIDIERIHARWSHEETAMMARLEAGAIQRGGVRFMNQFLVPRMPGRTLEAVKSKRRDATYKALVQRFLQAPQINLPELRDGDAPRQPDPQQENPPEPPSFDGAIRGAVADLVGGVDWQRLGFQGDRLCNIARRACDGGDVSGQLLGWLRDVFPVKRVSTRGDQSDLDVDGALVSRRTARTREYARVQELYRKEPKACLARILGDRREGANRAPNRDPAFIDFWRGVFSEASAEVEGWAEEVSDHGELARRVWDPISVEEVGRSRVRNGAAPGPDGIAVSVWNKLPPEAAALLFNVLLLGRCLPAELTRTRTVFIPKTDAPRTPADYRPISIASVVARHFHRVLSARVQRIPDLFTKYQRGFLSGVDGIADNLSVLDTMLTMSRRCCKHLHLAALDVSKAFDTVSHFAIVRACRSIFGSAETVLEEGGRRHFVQVRXGVRQXDPLSPLLFNLVLDRALKRLSTDVGFRLTDATKVTALAFADDVVLCATTARGLQTNLDVLEAELRLAGLLLNPNKCQALSLVASGRDHKVKLVTKPTFKVGQNTIHQVDASSIWKYLGIQFRGSGMCGCGSEGVAAGLKRITCAPLKPQQRMHLLRVFFLPKFYHAWTFGRLNAGVLRRLDVVVRTSVRTWLRLPHDIPVGYFHAPTKSGGLGIPQLSRFIPFLRLKRFDRLGRSAVDYVRECAFTDIADRKIRWCRERLSGIVDQVAGGRDALDAYWTAQLHQSVDGRALRESASVASSTQWLRCSTRAIPASDWLHYTAVHIGALPSRVRTSRGRRGGQDVSCRGGCLLDETPAHCIQVCHRTHGGRVLRHDAIAKRISADLMELGWIVTREVSFRTTAGVFRPDMVAVKEGVTVILDVQIVSPAPTLDEAHRRKVAKYRDRADLARYLAEAAVARGRAPPANIRFASATISWRGVWSAESVGSLRELGLSARHFDRYTTMALCGSWRNWVRFNASTASRMGRGRGDASPRRHENQQ

SEQ ID NO: 1472 - protein, 1123 aa, Megachile rotundata
SGPATSTFGETKSRLCEPTSALGCRPGAVVIQWAQIHKEKRKRIVGWPLGHLGSPTSLKLRHPRLQAKRIVPVLAELMQCLCARHVSGRSPQKSAWAFTLEERTSACGVDAMFVCSTCQRSFATKIGLGVHVRRAHVEVANAAISVERVKDRWSEEERRIMAAVEVRGVLSGARFINEYIMSHLQTSRTLESVKGTRKNPKYKELVATLLEEARTSVREESPRSAVNDSATQPSGPSDTRSLRTEHLFTESTEPFEHRIRELIGDLEGVTDFRAELLVSIAEQQLQGDEVAESLTRWLGEVFKPENQQQQVQRKRRRQRKAPVSGQLPKWRERRRDYAAMQTLFHRNPSLAAGRVLDGKNESRPPDLPEMTAFWEPILTEQSAEHRAVGPASEKSELCSVWGPVEKEELLSSVPPLDTAVGPDGVTARQWRAVLPAVRALLYNIILKRGSFPASMLESRTVFLPKKQHSVNPADFRPISIASVVVRQLHKILAMRLRRTNLVDERQRCMDDGCAENITVLASLLDDARHGLKELHLVSLDCAKAFDSVSHHAIDATLKECGLPAGFVQYISRTYSDSSTRLEVGRNRSEPIKTNRGVRQGDPLSTLIFCLCFDRVARTLSPHIGYDLNNTRISTLLYADDAFLVSTTAPGMNILLRSVEESAGEVGLSFNTSKCSALSLIPSGKEKKMKVGTTPTFKTSQGFITQITPSQEWRYLGVDFQYSGPKKASRSLKIELERISKAPLKPQQRLLILRVYLLPRYYHHLVLSRTTLGHLRGLDLQVRAAVRRWLSLPRDIPIAYFHTTAKEGGLGLPAFETSIPCLMLARLRSMETSTCKAARAAVQGFWVQKRIHWATAALTKNGEALTCKADVDRWWASRLHKSVDGRELRECSGVGSSSTWVNSALNITGRDYVQYHHVRINSLPTRIRTSRGVRREGMEVTCRAGCQVTETAAHVIQSCHRTHGGRILRHNAVCKVLASGLRDKGWEVREEPKLRTRQGLRKPDIVAIKDGVARVIDAQVVSGSGPLDEAHETKRKYYSDNGDVTAAIARECNIAPSNVAYSSCTISWRGVWSPRSAADLLQVGLSKKLLGFITLRVLRGSHLNWTRWNKMTTMRVHHQRTGIG

SEQ ID NO: 1473 - protein, 1133 aa, Apis mellifera
MSSNEEGASDTGAPGPGVPVADVSAADGRATYDDHGMSTDYEKQTIELPLNGQIQCLWCHIEGRNQRFLQESQYLKHKDTQHPKGEIIWRCAACQKEFEKLHGCRCHLPKCKGRKEAKGVAKFKCDSCEESFLTQRGLSMHELHRHPAIRNLKRTQGTSRGNTRPINRASVWSKEETDLLIKLNERYKHLKQPNVALKEYFPDKTLKQISDKRRLLPVQEPEDVATTDETGPPPSDSSEESIYESATEDEGGGDMQQTAPNDSWKEPFIQSIRTNHLEEEDSLRKVEEAIERMAMNEGVTEQEVGTLLEQFVDSLTQSPTTERKGSRRKSQKTTKRKTTHNNRKKFLYAKHQELYKKSPRRLLELALSGESSSGREVVNLPEADSVGPLYKSLWGQIGPEKTHRNQPMCNNIDMSEIWTPIALESLVEKFKKIKSDTAAGADQIKKFHLRKKGALHVFAKLCNLLMLHRIYPAQWKTNRTTLIPKPGKSAEEVENWRPITIGSLLGRIYSAMIDRKLRSKIKQHIRQKGFTQEDGCKNNIAILSSALTKMKEDSGGIITIIDISKAFDTVPHGEISQSLMNKGVPSPICEYIQKMYIGCKTIIYCRDKKTLPVDILRGVKQGDPLSPLLFNLIIDPIIGTLDETTEGIKLENENISVLAFADDLVLLAKDKETADKQNRLINEYLDDLKMKVSAEKCTTFEIKRQNKTWFLGDPQLTLGQQRIPYADPEAAIKYLGTNFNPWRGLCKTSIKEIIDAARTVKQLKLKPHQKINLIRTYLLPRYIHKLVANPPPLGTLDLIDKELKTIIKEILHLHPSTTDGLIYTDKSHGGLGIQRVANIVKLAKLKHSILMTRSEDNAVKIALNGQEGMVKRYATSIGLQWPCGIEEIEETRKKLKRADTNKWKTLISQGQGIKEFFGDKTGNAWLYNPEMLRPSRYLDALKLRTNTYGTKAALHRAKRDIDINCRRCGVQVETLGHILGLCTHTKNKRIKRHDEICDLIAKNVSKEYVIFREPEVEVNGDRRKPDMVIKDHDKVYVVDVTVRYENNDSLNKAYKEKENKYKETAEIMRRDLKAKESRVLPVVIGSRGAVPRATIENLKVLGLQTKHALTASLIALRSSIEMANEFLDYDHTT

SEQ ID NO: 1474 - protein, 1279 aa, Nasonia vitripennis
  MOD_RES (81)..(81): Any amino acid
  MOD_RES (111)..(111): Any amino acid
TFAPTHPMVRSGPCRKTKRPGSDYRESLIMDSGNNVASEPRGAVDVTSAAPIGAELNAEPCEGRNQRREAALSAQTRRRNXARRARNAQQADEPGDDEEIETHGPLTIRTXEPMEIVAIAKNPQACPKCLQGGTQLLCMGSWELSRHINKEHPSVDVTWVCGACQRRCTTLRSWSCHVLHCKGRQEPKDLPFKCEHCSLSFDSQIGLSQHERHVHPEVRNDKRAAEANKPKGKSGRRPSIWSDEDLLLIRELESEYHGARNINEKIAEHFPDRTGRQVSDARRRKDYAALRGRGGPQGPAEGVEAIEEVDEGEIPEGEELVATDGAALESGPPENGGSAPAEQVNAPALESSSQQDRECSPAVGSDEQIEDSSDDDEFSDALGEISLPEPLSVERTTISPPPRDDWKGPMRWEICNASEEAGSYANWVTGLQELVRNNALSEIGLDSLYDQLIQIMRHPSDDNEQDRLQLNARGPPRRGHRKNRRRRRLTAADRKRFAFARCQDLWNNNPKKLAELVIANDLSILQRRQAPGRTETQTLYNELWGRVGPNIEAPRRTEDPIPVSRIFTPITPQEIMGRIRRIKNDSAAGPDGVTKDDLRGRGVSIALSKLFNSILLAGYYPKAWRENRTTLLPKPEKDPADVKNWRPITISSMVSRVYSGLLDQRVRAVIKQCDRQKGFTEENGCFSNIQLLDDAVSNAKKAGGVITILDVSKAFDTVPHAVIQGCLEKKGIPETVAAYISSMYRDCSTAIRTRSGDVKIGMKRGVKQGDPLSPLIFNLVLEPLLERLQETSGVEIEGMNLSCAAFADDIVCFANTAPEAGRQLRMVADYLGRLDMSLSVSKCIAVEYVPHRKTWYTKNPGLEVNGNAVPSISPSETFKYLGAKVSPWKGLLEGFESDAFREVISRVQRLPLKPMQKVDLLQMYIFPRYTYGLITSPPAKAVLKTIDRIIRTRIKEILHLPESVSSSFLYTPRKQGGLGLLEVEKMVLIAALRNGLRARQSHDPVTRAAMNSNAADDRLKSYADALRLHWPLTTKELDTYKYQLRLSYAQKWAEQKWQGQGVEEFAQDPVGNSWLQRYDLLPASRYIDAIKLRTNTYPTRALMKIIDGRVDSSCRKCQGSSETLGHILGRCRYTKDKRISRHNEIKDLLKARLAKNHQVMDEPQITVRGQRFKPDLVVKTNEGRVHVIDVTVRYEHRTYLDEGRTEKIGKYRQILSTLRRDLHSNAEEVIPIVIGSRGAIPRETRKALSKLGIGKSDWLTISLIALRSSLEIVNAFMDD

SEQ ID NO: 1475 - protein, 1104 aa, Ciona intestinalis
MGEWPWVSWSLTVLVEKWRPFTILQPYPMPGQLRVDVYLPRKTSYLMDKNIYENTTSPGGGPLCGEKTHRSDVIIPPPGFAPSTDTASNTLGENVDASATTSSANPLSQEPGWCESCSKLFKSQRGLRVHQRSKHPELYHSQNQPLPRSKARWSDEEMVIFAREEIANRKIRFINQHLHKVFPHRTLESIKGLRGKNVRYARIMADLEAEMTSQPEAATSLCTETSENLASSNVLPQTRGWAENLVENIDTAHLANLGPLSQFEPGKPSSSTKEAINTEYNDWISKWLPSGAAHRERRANPPSTKLNARATRRLQYSRIQNLYKLNRSACAQEVLSGAWKVQSGELNLKEVQPFWEKMFRKESAKDRRKPKPTGEVLWGLMEPLTIAEVGSTLKSTTPSAPGPDKLTLDGVKRIPIAELVSHYNLWLYAGYQPEGLREGITTLIPKIKGTRDPAKLRPITVSSFICRIFHRCLAQRMETSLPLGERQKAFRKVDGICHNIWSLRSLIHNSKDNLKELNITFLDVRKAFDSISHKSLGIAAARLGLPPPLITYISNLYPNCSTKLKVNGKISKPIEVRRGVRQGDPLSPLLFNAVMDWALSELDPRVGVQIGEQRINHLAFADDIILVSSTKIGMVSSINTLSRHLAKSGLEISAGKEGKSASMAIVVDGKKKMWTVDPLPRFKVNSQKIPALSITQQYKYLGINIDAQGARNDAARILTEGLAELSRAPLKPQQRLYLLRVHLLPKLQHGLVLSSCAKRALTYLDKSVRSAIRRWLTLPKDTPTAFYHAKACDGGLGITRLEHTIPILKRNRMMKLTLSEDPVIMELVKLTYFTNLLHKYSNVKLLNSWPVTDKDSLARAEASMLHTSVDGRGLSNCSDVPRQSDWVTNGASLLSGRDFIGAIKVRGNLLPTKVSAARGRQREITCDCCRRPESLGHILQTCPRTWGPRISRHDSLLKRVRNQACLKNWTPIIEPSIPTNIGLRRPDLVLAKGNIAFLVDATVVADNANMQLQHEAKVEKYNNSDIKEWIKVHCPGVDEVRVTSLTANWRGCLYGGSASFLTEDLGLPKAELSLLSAKINEKGYYLWCAHYRGTARLWNRPLRS

SEQ ID NO: 1476 - protein, 1115 aa, Nasonia giraulti
WVTSPRRPRYVGPQKKKASDGNDGRAAARAEPTNPGGPDRADDDEGDVKFWCEFPGCDRFFMTRSGRGLHHKKGHPDWNDQRNLAGKQHRKEIWSEEERLLLAKKEAELAISGARFINVELRDFTARSLDAIKGQRKRPDYKILVEKFVRELRVRGIRQGVASRSQQARAMAVAGAPAATSSGAPPVATQPPPSGRVLRSQVVEAPAMEIPVAESEGDSSGDELFEDVEPVRLSDLPPDRFTIYFAGLEIPGTEDIYAHRLHTICLMTTWRTKEEVRLELGLFLKDLFPSKGSQERPERTNLPDPRNRIERRRGEYKKCQDLWRRNKSTCVQRILKEDLSQGECLPRELMEPFWNATFTQNPGTAPVLPPPTEVYSSVWEPIRPENIKGNYPPQNTAAGIDGLTVGDLKGVSREMLARIFNLFMWCGKLPEHLCASRTILLPKKPGAKVPGEFRPITVTSVLIRTFHKVLAERLKVVPLDPRQRGFRESDGCAENVMLLDMTIRYHHERRRKMFLALLDMAKAFDSVSFESMREVLTTKGIPTPFIEYFMTHLEDSFTVLQHGNWQSGKIHPTCGVKQGDPLSPPIFNFIMDEMLKRLPKEIGVNLDGLFVNAMAFADDLSLVANTEQGLQILIDEATSFLGLCGLRANPNKCVTLAIKTIPKEKKTAIDPSSHFRIGNAVIPSLKRTDEWVYLGIKFNSNGRLISDAKPKLIKDLELLTKAPLKPQQRLWALKVIVIPGILYRGTLGSSTAGYLRSLDCVIRAYVRRWLRLPGDCPNGYFHAAVADGGLGVHPIRYKAMVDRLARLRKLEKSAYITGPEAARYLQRQVSIAENRLRDGANRIMSDASMLREFLRELLYKSFDGRPLENSSKVPGQHRWVEEPTRFLSGADYMNCIRARIAALPTAARCARGRLKDKHCRAGCGNVETLNHVLQFCHRTHGTRIGRHDAVVKYVVGGLKKRGYAVKEEPKIVLQDVVYKPDMVATKEGKTLILDAQVLGDQRDMRLAHEDKLRKYGAPEFKRKIRSETGSATIKSLSVTLSWRGLWGPDSVKGLLEEGVILKKDLKILSTRVLIGALAGWRRFNERTSMATSGRREEVTTRMVRRWKRRERVGVG

SEQ ID NO: 1477 - protein, 1013 aa, Lepidurus arcticus
  MOD_RES (753)..(753): Any amino acid
MSGKSSKPRTVSSGSSSQETPPSGSNACDICGKCFMKPVGLSRVHPSQYHARLEKNQPKAKKFRWTDEDLYFLAKKEAELLHLGSIKFVNKELAEFFPEKSVDQIRGQRRSETYKQQVLSIHSELLKLQTVADSPPPSRIPAKEVSAWLDFFLALPKTKNKFSEDKLDQLIRTAQDGTLILDDLDLYLREVLVQPTSQGEKQAKLLPPPKSSREKRDREYARAQNLYRKNKTACVNAILDGNKKCENKIPDIDDFWKTIFESHSPPDAEPVCYVVDEEPTNIWSWISFFEMNHNYPDSSTSPGPDGVTARMLRSIPARVLNKLLNLLLFIEDLPAVFKCHRTVLIPKIDNPTSPGEFRPITISSIVVRQLNKIIAARVSEGVPINPRQKAFRQIDGCAENVFLLDFILRDAKTKIKSLSLATVDIKKAFDSVSHHSIFRAIRGARCPENLVNYIQNSYSGCTTQISVGGSISASKIPMNRGVKQGDPLSPVLFNLVINEIIRKLPASIGYPINSELSINCIAYADDLILVTNTREGLKLLLGLLNEELPKRGLELNASKCFGLSLTALGKLKKTHLCTSDQLDLHGTLIKNLTAEESWVYLGVPFSHIGRSKSFSPDLEALLNKLQKSPLKLQQKLFALRVYLIPRLLHGLVLSRVAIGELKIMDKLILKHLRVWLRLPKDTPLGFFYSPVKLGGLGIKNLRTNVLKCRKQRIERMLVSPDDVVRLVAESEIFLKETDKLKDLLTINGMCLDXRNVPRTGKNNKFWSERLYTSFDGKTLAYSEYFTQGGGWIREDKILQPAHVFAECIKLRINALPTKSRVAHGRPTKDRSCRAGCLDVQKVPTIETINHIAQVCPRTHGARIKRHDRLVQFLSLNLRKNPKRNVLVEYNFRTVAGIRKPDIIVIEDTRAVILDVQVVGDSSNLEMEYLEKSRKYSNDANFINALQKLYPTVTNLTFHAVTFNNRGLIAKSTVAALRMLGVPPRCIMILCVISLEKTLEVWRMFNQSTASARK

SEQ ID NO: 1478 - protein, 1016 aa, Lepidurus couesii
MSEESRPKQTASKRGAAVEKTMMSGTYVCTLCGRSFEKSVGLSLHTNRMHPEAYNKLKEAKKPVLKKARWSEEEVFLLAQKEAELSFIGGIKFMNIELHKIFPERELEGIKGQRKNPTYKAQVVSLLAEIRESKANDSSSSSSSSSSCDSASLGISNWLEFLLALPKTSNQFQEGRLDRLISDALRGVDVLENLDAYLLEVFAKPMAQNPCPKPPPPAKNSRERRDREYSRVQNFYKKNRSACINSILDGNTRSQNVIPGLTKFWTETFEKNSPPDDEAPDQFVADEPRDMYKWITFYEMSQDYLDSSTAPGVDGFSAKQLRSMSPRVLNKILNLLLLSENLPNSFKMHKTVLIPKIDDPKSPGDFRPITISPVLARLLNKILAARLSKLVPISQRQKAFLPVDGCGENIFLLDYILRSSKKSSKSVAMAVLDVKKAFDSVSHHSILRALNEAKCPINFINFVRNSYDGCTTKLTCGGTSFPDSVRMNRGVKQGDPLSPVLFNLIIDSAIRKLPDSIGYVIRDGLKINCLAYADDLILVASSRAGLKTLLNIVAEHLSLRGLDLNAAKCHGLSIIASGKAKTTYVSAADSLDLDGQPIKNLGVLDTWTYLGIPFSHLGRAEKVSPDLTNLLNKLQKAPLKLQQKLYAVRNFVIPRALHGLILSKTNLKELNTLDRAIRVFLRTLLYLPKDTPLGFFHSPIKSGGLGITCFRTSVLKCRLQRIARMRSSCDGVIQAVAESDIFADEYAKLRDLIRINGNVLDTTESIKRYWAQRLHSSVDGKTLAYMDYFPQGNLWMSEDKVSQRSYVFADCVKLRINAIPTRVRVSRGRPNKEMCCRAKCFDSQRMPAFESLNHITQVCPRTHGSRIQRHDKIAKFLFKNLNNCPSRSVLYEPHFVTVDGLRKPDIIIYDDSHMVVLDVQVVSDSANLEKEFECKAKKYANDVALRSAMLIKYPFIKSFSFVAATYNNRGLIAKSSVQVLRQLGLSPRSIMVSILICLEGTLETWRIFNQSTMNAH

SEQ ID NO: 1479 - protein, 1020 aa, Lepidurus couesii
  MOD_RES (757)..(757): Any amino acid
MSGKSSKPRTVSSGSSSQETPPSGSNACDICGKCFMKPVGLSLHMSKVHPTQYHARLEKNQPKAKKFRWTDEDLYFLAKKEAELLLLGGIKFMNKELAEFFPEKSVDQIKGQRRSETYKQQVVSIHSELLKLQAVADSPPPSRIPAKEVSAWLDFLLALPKTKNKFSEDKLDQLIRTAQEGTPVLNDLDLYLREVLVQPTRQGERQAKPLPPPKSSREKRDREYARVQNFYRKNKTACVNAILDGNKKCENKIPDIDEFWKAIFESQSPPDAEPVSYVVDEEPKNIWSWISFFEMNRNYPDTSTSPGPDGVTARMLRSIPARVLNKLLNLLLFIEDLPAVFKCHRTVLIPKVDNPALPGEFRPITISSIIVRQLNKIIAARVSEGVPINPRQKAFRQIDGCAENVFLLDFILRDAKTKIKSLSLATVDIKKAFDSVSHHSIFRAIRGARCPENLVNYIQNSYSGCTTQISVGGSISTTKILMNRGVKQGDPLSPVLFNLVINEIIRKLPASIGYPINSELSINCIAYADDLILVANTREGLKLLLNLLNEELPKRGLELNASKCFGLSLTALGKLKKTHLCTSDQLDLHGTLIKNLTAEESWVYLGVPFSHIGRSKSFSPDLEALLNKLQKSPLKLQQKLFALRVYLIPRLLHGLVLSRVAIGELKIMDKLILKHLRVWLRLPKDTPLGFFYSPVKLGGLGIKNLRTNVLKCRKQRIERMLVSPDDVVRLVAESEIFLKETDKLKDLLTINGMCLDXRNVPRTGKNNKFWSERLYTSFDGKTLAYSEYFTQGGGWIREDKILQPAHVFAECIKLRINALPTKSRVAHGRPTKDRSCRAGCLDVQKVPAIETINHIAQVCPRTHGARIKRHDRLVQFLSLNLRKNPKRNVLVEYNFRTVAGIRKPDIIVIEDTRAAILDVQVVGDSSNLEMEYLEKSRKYSNDATLSMRINALQKLYPTVTSLTFHAVTFNNRGLIAKSTVAALRMLGVPPRCIMILCVISLEKTLEVWRMFNQSTASARK

SEQ ID NO: 1480 - protein, 1138 aa, Nematostella vectensis
MLRGTGNMNDKRDGSATADPTSALLGAVGDGSLVCNLCGLACKSRGGLSIHRRSKHATVYHAERQPAPRAKARWTNDEMILVARKQIASEKSRCSAVVEGMREAVPHRTFDAVKSLKTKNRNYTRILEQIRAECSEEEVIESGVLKDRTENVCVQTTSNVPGSAGRAASVELEGNIQVGHQLAQKTMAGNNSRKQPANHTNWAEFNIEEGNITLRKSKRKANGMPDATHRPGPPTVDSLKHPVCLLQGAADKRDEPHTVEQLYYNIEEGMPLAEEQQWSEKLFDAIDSSLLSVEVELGRIVPGCPDEETRQLIDREFLDFIHSYSREKPPQRGLAKSKPPPKGPKSLRRQQYRQLQRLWDKNRSAAAEQALTGKWQEVRTAAGVPLSLMEVPWREIFETPSTTDVREPAPAGPVLWQLLRPVTIAEVEDAISSKKSASGPDGVPCAALQTMGAASLAAHFNLWLLAGTQPKRLTECRTIFVPKEVNTHLPLHHRPITIGSVVVRLFHQILGKPMEAVLPLGSGQRGFRKGDGICQNIWLLHTLIRRSTDLLRPLKLVFLDVKKAFDSVSHESLLIAAKRLGVPGPLLTYINELYSRSETVFEVGGESSGSVKVSQGVKQGDPLSSTLFNCVIDWAVSDLDPHIGVLLGESRVSFLAYADDLVLLSETEAALTSQLNSIEKSLAHCGLKLSTGDSGKSASLNIVIDGKAKRWVVNPTPFLRASGGEIRSLVANETYKYLGINIGAQGVKAAEYNAFKEALDNLSRAPLKPQQRLFLLKTYLLPQLHHSLVLSRTTGKLLNSLDALVRKAVRGWLKLPHDTHRAFFYAHQADGGLNVPSLYHLIPLLRRSRYERLTRVEDPEIREVSRTDYFKRVLGAAAAATTVAGHRIDSKVTLRLAWREALYASADGRGLSQCPLVPEVHSWVTDVSGLQTGSQYISAVRLRGALLPTAVRKSRGRGGVNSNCDCCGRGQPEFLGHVLQTCPRTWGSRISRHNHVLSLIAKACRSRRWQVLEEPIIQTPAQLLKPDLVIWNHQAAYVVDVSVPGDNTPLSTCHNRKVAYYSGESVREWVRSKTGHNPTVSSVVINWRGAMAKESYRLLTKDLRLAKTLPRLLVLRVLEGGHGIWLNFHRSTFAVGVT

SEQ ID NO: 1481 - protein, 1148 aa, Schistosoma mansoni
MPVSTGAETDITSSLPIPASSIVSPNYTLPDSSSTCLICFAIFPTHNILLSHATAIHHISCPPTPVQDGSQQMSCVLCAAAFSSNRGLTQHIRHRHISEYNELIRQRIAVQPTSRIWSPFDDASLLSIANHEAHRFPTKNDLYQHISTVLTRRTAEAVKRRLLHLQWSRSPTAITTSSNNHTTTDIPNTEARYIFPVDLDEHPPLSDATTPDASTHPLPELLVILTPLPSPTRLQNISESQTSHESNRNSMHTPPTYACDSDESLGVTPSSTIPSCFHSYRDPLAEQRSKLLRASASLLQSSCTRIRSSSLLAFLQNASTLMDEEHVSTFLNSHGEFVFPRTWTPSRPKHPSHAPANVSRKKRRKIEYAHIQTLFHHRPKDAANTVLDGRWRNPYVANHSMIPDFDCFWTTVFTKTNSPDSREITPIIPMTPSLIDPILPSDVTWALKEMHGTAGGIDRLTSYDLMRFGKNGLAGYLNMLLALAYLPTNLSTARVTFVPKSSSPVSPEDFRPISVAPVATRCLHKILAKRWMPLFPQERLQFAFLNRDGCFEAVNLLHSVIRHVHTRHAGASFALLDISRAFDTVSHDSIIRAAKRYGAPELLCRYLNNYYRRSTSCVNRTELHPTCGVKQGDPLSPLLFIMVLDELLEGLDPMTHLTVDGESLNYIAYADDLVVFAPNAELLQRKLDRISLLLHEAGWSINPEKSRTLDLISGGHSKITALSQTEFTIAGMRIPPLSAADTFDYLGIKSNFKGRCPVAHIDLLNNYLTEISCAPLKPQQRMKILKDNLLPRLLYPLTLGIVHLKTLKSMDRNIHTAIRKWLRLPSDTPLAYFHSPVAAGGLGILHLSSSVPFHRRKRLETLLSSPNRLLHKLPTSPTLASYSHLSQLPVRIGHETVTSREEASNSWVRRLHSSCDGKGLLLAPLSTESHAWLRYPQSIFPSVYINAVKLRGGLLSTKVRRSRGGRVTNGLNCRGGCAHHETIHHILQHCALTHDIRCKRHNELCNLVAKKLRRQKIHFLQEPCIPLEKTYCKPDFIIIRDSIAYVLDVTVSDDGNTHASRLLKISKYGNERTVASIKRFLTSSGYIITSVRQTPVLTFRGILERASSQSLRRLCFSSRDLGDLCLSAIQGSIKIYNTYMRGTQRLNE

SEQ ID NO: 1482 - protein, 1031 aa, Triops cancriformis
MSQKRRPEKAVPDEGATAHDVAQPDKSKCSVCGETFKGPASVTMHMVKKHPVEFNELKMAKKPVPKKVRWSEEEIFQLARTEAELTLQGVRFINVELQKIFPAREIEGIKGQRKLAKYKELVKDQLDEIGRAPNPPEQEIGEDVPSPFKAWLELLLALPKTPNDFLEHKLDNIIVQALKEDVNSDQVFNDLNSYLKLILEPSGRAKSVPGEIIHGDPSGSAKTSVTKAPKPATVSSSRKKRRDAEFARIQRLYRKNRTSCINTILDGNTREHEAPKNMEGFWREIFERESPDDPDDPDIFLEEEASDIWKYISFYEMCNLYPPPSTAPGPDGFSSKDLRRMTPRVLNKILNLLLHLRDLPQILKSHRTVLIPKTDLPTKPGDFRPITISNILVRHLNKILANRVSHLIPINERQKAFLPIDGCAENIFTLDFILHHARTKIKSLSMAILDISKAFDSVSHHSIFRALREARCPIGFIKFIENCYGGCFTKLFCGGVKYPSEVSMNRGVKQGDPLSPVLFNLVIDGLIRQIPSALGFNVSDQVKVSCIAYADDLILIATTRAGLKTLLDLTNSYLAKRGLSLNPDKCSALSIVASGKQKLVYIASSEHFDLAGQKMRNLNVGDSWRYLGIQFSHLGRAEKVTPDLTCLINRLQKAPLKLQQKLYALRIYLIPRLIHGLTLSKTNLGELKTLDKLIRKYIRAWLHLPDDTPMGYFYTPLKAGGLGLPSLRLVILNNRLERILRMKASQDIIVRTIAESETLGVEIRKLHDLLSIDGTILDTSVKIHSFWAERLYSSYDGKCLCNSANFPPGNKWIGEDSLNQRSHIFADCLKLRINALPTRSRTARGRPLKDKPCRAGCRNSDGVKVIETLNHITQVCERTHGARVKRHDRLVDFAVKGLQRPHRVVLKEPHYKTVNGVRKPDIVIKIPDHTYICDFQVVSDTSCLELEFRKKALKYAEDKGLCDQLTRDHPGELSFTAITFNTRGLIAKSSVTALRKLGMPPRSIMTLQKICMEGSLEIWRIFNQTTAMARN

SEQ ID NO: 1483 - protein, 1056 aa, Drosophila ananassae
FERRKDPWGYRPPGTLKQIGATENNEPRNLNRFVRGESTASSLESTQFGTSAEVNLAGRVPCTICEMTFSSKRGLGVHMSHRHKDDLDAQRLRVDKKARWSEEETLMMARKEVELAASGVRFLNKKLAEIFTHRSADAISSYRKRSEYKAKLEQIRGQSVPTPEAEEINTTQRRPSNSEQNRRVPRSEGGPIAPTEQTNNEILRVLQGLAPVVCLPRWRAEVLQNIVDNAQVSGQETTLQSLSSYLMEIFPPRNEPHILTRPRTEPRNMRQRRRQQYARVQRNWDKHPGRCIKSLLEEDDESVMPNQEVMEPYWRRVMTQPSSSSIKRDMFNMEHSLERVWSAVNQRDLRATKVKLSSSPGPDGITPKTARSVPEGIMLRIMNLILWCGNLPYSIRLARTIFIPKKATANQPQDYRPISVPSVIVRQLNAILASRLSAAINWDTRQRGFLPTDGCADNTTIVDLVLREHHKRFKSCYIGTLDVSKAFDAVAHEAVYNTLASYGAPKGFINYLRKAYEGGGTMLAGNGWVSEAFIPARGVKQGDPLSPILFNLVIDRLLRSLPSEIGAKVGNAMTNAAAFADDIVLFAETPMGLQKLLDTTVCFLSSVGLTLNTDKCFTVSIKGQAKQKCTVVERRSFLIGGRECPSLKRTDEWKYLGIKFTAEGRARYDPAEDLGPKLLRLTRAPLKPQQKLFALRTVLIPQLYHKLTLGSVTIGVLKKFDKLVRYTARKWLGLPVDVPVSFFHAPHKSGGLGLPSLRWTAPMLRLKRLSNIKWPHLERSEVASSFVEEEMRRARDRLQAGSEELLTRSQVDSYLANRLHMSVDGCGLREAERFAPQHGWVSQPTRLLTGKEYTDGIKLRINALPSRSRTTRGRHELERRCRAGCDAPETTNHILQQCYRTHGRRIARHNGVVNFLKRGLERRGCVVHVEPSLQGETGLNKPDLVAIRQNRIYVIDTQIVTDGHSLDQAHQRKVGKYDTPDIRTNLRRSFGAFDIEFHSATVNWRGIWSGQSVKRLIASDLLSSGDSNIISVRVISGGLWSWRQFMYLSGYTRDWT

SEQ ID NO: 1484 - protein, 1022 aa, Drosophila melanogaster
MTTRPSVDIFPEDQYEPNAAATLSRVPCTVCGRSFNSKRGLGVHMRSRHPDELDEERRRVDIKARWSDEEKWMMARKEVELTANGCKHINKQLAVYFANRSVEAIKKLRQRGDYKEKIEQIRGQSALAPEVANLTIRRRPSRSEQDHQVTTSETTPITPFEQSNREILRTLRGYSPVECHSKWRAQELQTIIDRAHLEGKETTLQCLSLYLLGIFPAQGVRHTLTRPPRRPRNRRESRRQQYAVVQRNWDKHKGRCIKSLLNGTDESVMPSQEIMVPYWREVMTQPSPSSCSGEVIQMDHSLERVWSAITEQDLRASRVSLSSSPGPDGITPKSAREVPSGIMLRIMNLILWCGNLPHSIRLARTVFIPKTVTAKRPQDFRPISVPSVLVRQLNAILATRLNSSINWDPRQRGFLPTDGCADNATIVDLVLRHSHKHFRSCYIANLDVSKAFDSLSHASIYDTLRAYGAPKGFVDYVQNTYEGGGTSLNGDGWSSEEFVPARGVKQGDPLSPILFNLVMDRLLRTLPSEIGAKVGNAITNAAAFADDLVLFAETRMGLQVLLDKTLDFLSIVGLKLNADKCFTVGIKGQPKQKCTVLEAQSFYVGSSEIPSLKRTDEWKYLGINFTATGRVRCNPAEDIGPKLQRLTKAPLKPQQRLFALRTVLIPQLYHKLALGSVAIGVLRKTDKLIRYYVRRWLNLPLDVPIAFVHAPPKSGGLGIPSLRWVAPMLRLRRLSNIKWPHLTQNEVASSFLEAEKQRARDRLLAEQNELLSRPAIEKYWANKLYLSVDGSGLREGGHYGPQHGWVSQPTRLLTGKEYMDGIRLRINALPTKSRTTRGRHELERQCRAGCDAPETTNHIMQKCYRSHGRRVARHNCVVNRIKRGLEERGCVVIVEPSLQCESGLNKPDLVALRQNHIDVIDTQIVTDGHSMDDAHQRKINRYDRPDIRTELRRRFEAAGDIEFHSATLNWRGIWSGQSVKRLIAKGLLSKYDSHIISVQVMRGSLGCFKQFMYLSGFSRDWT

SEQ ID NO: 1485 - protein, 1070 aa, Drosophila persimilis
SSFGLIVTNLNSETVLWGCQPLGQFSLIGTNMQNTTPRIINTNSLTNQIPTVSSLGAQSEHSAQVNPNSGYQCTICESSFRSKSGLGVHMSRRHKDEFDQLRLRTDRKAQWSEEELSMMARKEIELAANGERYLNKKLAEVFTNRSVDAIKKCRQRERYKTKIEQLKGQAVPLPEALESETIQRRPSIRERDLLVTPPNTLGTTPTELSNSEILAVLQGYPPVVCNDQWRVEVLQSIVDGAQASGKEITLQRLSTYLMEVFPSQNDRPIQTRPPRRPRNRRQGRRQQYALTQRNWDKHKGRCIKAILDGTEGTATMPSQGIMGSYWRQVMTQTSPTYSGTNTTFRTEHPLEGVWSPITLGDLRVHRVSLTKSPGPDGITPRTVRSIPSGVMLRIMNLILWCGKLPVSIRQARTIFIPKVGNASRPQDFRPITVQSVMVRILNAILASRLTSSVDWDPRQRGFLPTDGCADNTTIVDLILRDHHKRCKSLYIATLDISKAFDSVSHAAVSATLTAYGAPKEFVDYVQNSYEVCGTTLNGDGWRSEEFIPARGVRQGDPLSPIIFNLIIDQLLRSYPNEIGATIGDHTTNAAAFADDIVLFAETRLGLQTMLDTTVDFLSSVGLTLNSDKCFTVGIKGQPKQKCTVVIPETFRIGSRSCPALKRTDEWKYLGITFTAQGRTRYSPADDLGPKLLRLTRSPLKPQQKLFALRTVLIPQLYHKLTLGSVMIGVLRKCDILVRSTVRKWLGLPLDVSTAFFHAPHTYGGLGIPSVRWVAPMLRMKRLSNIKWAHLAQSEAASSFLTDELNKARGRTLAGLNELTSRTEIETYWANRLYMSVDGRGLREAGLFRPQHGWVCQPTRLLTGQDYRNSIKLRINALPSRSRTTRGRNELERQCRAGCDAPETTNHILQNCYRTHGRRVARHNCVVNNLKRILEEKGHTVHVEPSLQLETSVSKPDLVCIRDNHACVIDAQIITDGLFLDDVHHRKVEKYKRPEVISALRREFGVSGNVEVLSATLNWRGIWSNQSVRRLIAKGLISSGDSNVISARVVTGGLYCFRQFMYLAGYTRDWT

SEQ ID NO: 1486 - protein, 1070 aa, Drosophila pseudoobscura
SSFGLIVTNLNSETVLWGCQPLGQFSLIGTNMQNTTPRIINTNSLTNQIPTVSSLGAQSEHSAQVNPNSGYQCTICESSFRSKSGLGVHMSRRHKDEFDQLRLRTDRKAQWSEEELSMMARKEIELAANGERYLNKKLAEVFTNRSVDAIKKCRQRERYKTKIEQLKGQAVPLPEALESETIQRRPSIRERDLLVTPPNTLGTTPTELSNREILAVLQGYPPVVCNDQWRVEVLQSIVDGAQASGKEITLQRLSTYLMEVFPSQNDRPIQTRPPRRPRNRRQGRRQQYALTQRNWDKHKGRCIKAILDGTEGTATMPSQGIMGSYWRQVMTQTSPTYSGTNTTFRTEHPLEGVWSPITLGDLRVHRVSLTKSPGPDGITPRTVRSIPSGVMLRIMNLILWCGKLPVSIRQARTIFIPKVGNASRPQDFRPITVQSVMVRILNAILASRLTSSVDWDPRQRGFLPTDGCADNTTIVDLILRDHHKRCKSLYIATLDISKAFDSVSHAAVSATLTAYGAPKEFVDYVQNSYEVCGTTLNGDGWRSEEFIPARGVRQGDPLSPIIFNLIIDQLLRSYPNEIGATIGDHTTNAAAFADDIVLFAETRLGLQTMLDTTVDFLSSVGLTLNSDKCFTVGIKGQPKQKCTVVIPETFRIGSRSCPALKRTDEWKYLGITFTAQGRTRYSPADDLGPKLLRLTRSPLKPQQKLFALRTVLIPQLYHKLTLGSVMIGVLRKCDILVRSTVRKWLGLPLDVSTAFFHAPHIYGGLGIPSVRWVAPMLRMKRLSNIKWAHLAQSEAASSFLTDELNKARGRTLAGLNELTSRSEIETYWANRLYMSVDGRGLREAGLFRPQHGWVCQPTRLLTGQDYRNGIKLRINALPSRSRTTRGRNELERQCRAGCDAPETTNHILQNCYRTHGRRVARHNCVVNNLKRILEEKGHTVHVEPSLQLETSVSKPDLVCIRDNHACVIDAQIITDGLFLDDVHHRKVEKYKRPEVISALRREFGVSGNVEVLSATLNWRGIWSNQSVRRLIAKGLISSGDSNVISARVVTGGLYCFRQFMYLAGYTRDWT

SEQ ID NO: 1487 - protein, 1057 aa, Drosophila sechellia
FERQNFSDGLVPQRKFIHIGTTNRNNEPRSNLRNLMTTRPSVDIFPEDQYEPNAAATLSRVPCTVCGRSFNSKRGLGVHMRSRHPDELDEERRRVDIKARWSEEEKWMMARKEVELTANGHKHINKQLAVYFANRSVEAIKKLRQRGDYKEKIEQIRRQSALVPEVANLTIRRRPSRSEQNHQVTTSETTPITPFEQSNREILRTLRGYSPVECHSKWRAQELQTIIDRAELEGKETTLQCLSLYLLGIFPAQGVRHTLTRPPRRPRNRRESRRQQYAVVQRNWDKHKGRCIKSLLNGTDESVMPSQEVMVPYWREVMTQPSPSSCSREVIQMDHSLERVWSAITEHDLRASRISLSSSPGPDGITPKTAREVPSGIMLRIMNLILWCGNLPHSIRLARTVFIPKTVTAKRPQDFRPISVPSVLVRQLNAILATRLNSSINWDPRQRGFLPTDGCADNATIVDLVLRHSHKHFRSCYIANLDVSKAFDSLSHASIYDTLRAYGAPKGFVDYVQNTYEGGGTSLNGDGWSSEEFVPARGVKQGDPLSPILFNLVMDRLLRNLPSEIGARVGNAITNAAAFADDLVLFAETRMGLQVLLDRTLDFLSLVGLKLNADKCFTVGIKGQPKQKCTVLEAQSFYVGSREIPSLKRTDEWKYLGINFTATGRVRCNPAEDIGPKLQRLTKAPLKPQQRMFALRTVLIPQLYHKLALGSVAIGILRKTDKLIRYYVRRWLNLPLDIPIAFIHAPPKSGGLGIPSLRWVAPMLRLRRLSNIKWPHLTQNEVASSFLEAEKQRARDRLLAEQNELLSRPAIEKYWANKLYLSVDGSGLREAGHWGPQHGWVNQPTRLLTGKEYIDGIRLRINALPTKSRTTRGRHELERQCRAGCDAPETTNHIMQKCYRSHGRRIARHNCVVNRIKRGLEERGCVVIVEPSLQCESGLNKPDLVALRQNHIDVIDIQIVTDGHSMDDAHQRKINRYDRPDIRTELRRRFEAAGDIEFHSATLNWRGIWSGQSVKRLIAKGLLSKYDSHIISVQVMRGSLGCFKQFMYLSGFSRDWT

SEQ ID NO: 1488 - protein, 1063 aa, Drosophila simulans
TCLAANLSGKNFSDGLVTQRKFTHIGTTNTNNEPRISLHNLMTTRPSVDIFPEDQYEPNAAATLSRVPCTVCGRSFNSKRGLGVHMRSRHPDELDEERRRVDIKARWSEEEKWMMARKEVELTANGHKHMNKQLAVYFANRSVEAIKKLRQRGDYKEKIEQIRGQSALVPEVANLTIRRRPSRSEQNHQVTTSETTPITPFEQSNREILRTLRGYSPVECHSKWRAQELQTIIDRAELEGKETTLQCLSLYLLGIFPAQGVRHTLTRPPRRPRNRRESRRQQYAVVQRNWDKHKGRCIKSLLNGTDESVMPSQEVMVPYWREVMTQPSPSSCSGEVIQMDHSLERVWSAITEHDLRASRISLSSSPGPDGITPKSAREVPSGIMLRIMNLILWCGNLPHSIRLARTVFIPKTVTAKRPQDFRPISVPSVLVRQLNAILATRLNSSINWDPRQRGFLPTDGCADNATIVDLVLRHSHKHFRSCYIANLDVSKAFDSLSHASIYDTLRAYGAPKGFVDYVQNTYEGGGTSLNGDGWSSEEFVPARGVKQGDPLSPILFNLVMDRLLRNLPSEIGAKVGNAITNAAAFADDLVLFAETRMGLQVLLDKTLDFLSLVGLKLNADKCFTVGIKGQPKQKCTVLEAQSFYVGSREIPSLKRTDEWKYLGINFTATGRVRCNPAEDIGPKLQRLTKAPLKPQQRMFALRTVLIPQLYHKLALGSVAIGVLRKTDKLIRYYVRRWLNLPLDVPIAFIHAPPKSGGLGIPSLRWVAPMLRLRRLSNIKWPHLTQNEVASSFLEAEKQRARDRLLAEQNELLSRPAIEKYWANKLYLSVDGSGLREAGHWGPQHGWVNQPTRLLTGKEYIDGIRLRINALPTKSRTTRGRHELERQCRAGCDAPETTNHIMQKCYRSHGRRVARHNCVVNRIKRGLEERGCVVIVEPSLQCESGLNKPDLVALRQDHIDVIDIQIVTDGHSMDDAHQRKINRYDRPDIRTELRRRFEAAGDIEFHSATLNWRGIWSGQSVKRLIAKGLLSKYDSHIISVQVMRGSLGCFKQFMYLSGFSRDWT

SEQ ID NO: 1489 - protein, 1057 aa, Drosophila yakuba
FERRIFPKGLVPLTKDNHIGTTNLQNEPRIFTNDLLTTRPSVDHVPEDQYEPNAAATLSRVPCTVCDRSFNSKRGLGVHMRSRHPDELDEERRRVDIKARWSEEEKWMMARKEVELMANGFKHINKQLAVYFANRSVEAIKKLRQRGDYKEKIEQIRGQSALAPEVANLTIRRRPSRSEQDHQVPTSEASPITPLEQSNREILRTLRGYSPVVCPSKWRAQELQTIIDRAEFEGKETTLQCLSLYLQGIFPVQGVRHTLTRPPRRPRNRRESRRQQYAVIQRNWDKHKGRCIKSLLNGTDESVMPSREFMEPYWREVMTQPSPSSCNGEVIRTDHSLETVWSAITEQDLRASRVSLSSSPGPDGVTPKTAREVPSGIMLRIMNLILWCGNLPHSIRLARTIFIPKTVTAKRPQDFRPISVPSVLVRQLNAILATRLTSSIDWDPRQRGFSPTDGCADNATIVDLVLRHSHKYFKSCYIANLDVSKAFDSLSHAAIYGTLRAYGAPKGFVDYVQKTYEGGGISLNGEGWCSEEFVPARGVKQGDPLSPILFNLVIDRLLRALPSEIGTKVGNAMINAAAFADDLVLFAETRMGLQTLLDKTVDFLSTVGLKLNADKCFTVGIKGQPKQKCTVLEAQSFCVGSREIPTLKRTDEWKYLGIHFTASGRVRCNPAEDIGPKLQRLSEAPLKPQQRLFALRTVLIPQLYHKLSLGSVTIGVLRKTDKLIRFYVRRWLNLPSDVPIAFVHAPPKCGGLGIPSLRWVAPMLRLRRLSNIKWPHLVQSEEASSFIEAEKQRARGRLIAEQNELLSRPAIEKYWANRLYLSVDGGGLREAGHYGPQHGWVSQPTRLLTGKEYLDGIRLRINALPTKSRTTRGRHELERQCRAGCDAPETTNHIMQKCYRSHGRRVARHNCVVNRIKRGLEERGCVVIAEPSLQCESGLNKPDLVVLRQNHIDVIDVQVVTDGHSMDEAHQRKINRYDRPDIRTELRRRFEAAGDIEFHSATLNWRGIWSGQSVKRLIAKGLLSKYDSHIISVQVMRGSLGCFRQFMYLSGFSRDWT

SEQ ID NO: 1490 - protein, 1309 aa, Kalotermes flavicollis
MEVPLTSSLGSGATQAPGTPELLGEHTVERPGLDQGHSYGLLMDDVELPVRLPFFGPLICPGCRTLLTSEETISSHHRRVHPDARTRWVCYGCDSPFMTYRAIKCHLPKCSGRKVVTGDHICNGCTKRFESQRGLSLHKRRAHPGLRNEEMLEPPVRAERRPNAHKSSIWSIDEIRILEQYEAAYVGDLHINMKIAAHLPFKTNKQVSNYRNDRRKKSRTATDASQQGLGPNDGNRGIVPSGQSSPLFLEGSDAEGDEDVFNVLVPPTLGGLEPAGQVHSLSEGETSPLVGEADPCFMGGTPSAGEASGSTLLGPDPTPADGYSLVRKDLQLSVQTSPLLAVGSVGTESVQFERGVLSCGTPPEFLHPEQFAHCANNDPVLNASEEQVHAPLGEEANDLPDNNHPSELGVDPEDPTCSPATEQVQPSSEEEADDPFAQFKAWRRRVASYALKIETGVLPAQVDDLLRRLRDGDTQSKVTCEEVEEVVLSLTRTILGGTAPKKRVEGRTKWTYKSRTNHEARKRIMYARCQDLYRRRPQRPVERAVGYQAEESLLDNQDERPSHGAFETFYTGLWGKSGQCNITMPPGVPRHTGHVLREVTPKDIYSRLRKLKKDYAPGPDGVTKLKVQSMGAYPSLLAKVYNLVMLTGYFSSCWKEHKTSLIPKDRGSPMDVSNWRPITIGSLLSRIYTGLIERRLRTVSDIHQRQVGFMPVNGCAANLFIFDECIRQAKKEGTIVGSLIDVAKAFDTVPHEAILRALSSQGVDEHTMAHIRDMYSGIRTRINGKGSDIPLVRGVKQGDPLSPMLFNMVMDPLIRDLQRKGFRIGGHEIGALAFADDIVLLADSIDGAQDHVDQVGRYMNKLGMTLNPRKSSSFLITAMRKTWICRDPGLSIGETKVPGARPSSALKYLGVNYTLSEGLESGALIDKLMQAVNRARGLALKPLQKVNLILERIIPKFLYGIILGGPSLTRLHAADKCVRMAVKEILHLHPSTTDHVLYARKKDGGMGIPRLAHLVRLASLRSGLALLASGDVAVQAAGMAGDLEGRCKKVANDLRLNWPVTLRDVVRASNKFKSQESKDWERLASQGHGVKDFRNDRLGNCWLYDPTVLSSSRYTDALRLRTNTFGVNVALRRADKDLEVNCRRCHGKPETLGHVLGECVAGKGMRIQRHDKMAAFVATKCEEKGYQTTREQLFSIEQGKLKPDLVVIDGERALIVDVTVRFESGNALSRGASEKIEKYQPLADYFVSQGAVREANVLPIVVGSRGAITQATLKSLATLGLDVERVGKYLAICAVASSVEIACMHLDYT

SEQ ID NO: 1491 - protein, 1198 aa, Reticulitermes lucifugus
MMADYNNSVDHALEDNTRLIFARDAVLARVCGPFDNLECGLCGVLLTSLQGVREHCHRAHHNLDLTFQCTKCDKGFSSYRGICCHFSKCIGARISVSEGPLSCSECEREFDSKRALSTHERHMHPGIRNAKRLKDFNPRGGGGKTIHGNTKWTEEEVQLLVSLSKRFEGYKSINKEISLILTSKTCKQISDKRRYLNLHNGNGGLAAAEAVLEFCEDSHPEVTESDGAVLSEIMDEECHQSSVTMRSSIVHGDIGREVQGKELVRIPPDNSVMGNCVVLLRKLATDKRSDLDLSKDKELRIDIEKATKANRESADGRVIQSVAGNEIDPDTFQWKELLLGQVRGFPRVDENSELFDLDDKLTKELSSDSPVWNDNCELIVSDLCQVLCKKKYELGRQHHVRKGKRHRGIHHKREKFRECQKIFRKSPRKLAEYLYRDKDLSHISKDASTPQGIEQYYSQLWGEPELLESNTIEEKLPSSSLFDCLPPITPEEVEGRIHKIRPSSAPGLDGVRKIHLVGKGITLVLVKLYNLLFLTGGYPECWKRNRTVFIPKIGKDLSEVGGWRPLTIGSLLARMYSAFLERRIRRVTSLSLSQRGFTNIQGCHVNLTILKEGIRQAKVKNGGVIVSVDIEKAFDTIPHSVIFSRLASQGVPPLLRKIISNMYKDVYTVIEGQCIPIKRGVKQGDPLSPLLFNIAIDPVLRSLEEFQGGLPLGNSAIKILAFADDIILGASSAGQAQQMVDMLGIGLTSCGLGVSHRKCFGFQIVNKNKTWTIVDPMITLNGSSLPFSGPEDRLPYLGVDINPWDRKSRYDAGQRLISAAKRGSQLSLKPQQKINLITAFLLPKFLYILIEDPPSPAYLKSIDHDLRQIYKNILHLPNCVSTAFMYSPKRDGGLGLPRLSCLVPLAHLKAGIKLGSLQDSLVREITTSDRFVRTMGSVAHSLWASWSLTLQDIYKLKSALKRREAKAWESCVSQGQGAAQFRGDSIGNNWLHNPGTYRPGQYIEALKLRANLTGVRVNLKRSGYNVPITCRFCKDIPETQAHVLGLCPKTKGMRIQRHDSIVNRVRDKLKTKSPVALMHEQNFTVEEGQVFKPDIVTILGEVGYVIDVTVRYDDRDYIKDASVEKIRKYEALKGYLKDLYPQLNKVEVLPLVFGSRGAVPGSTVHNMGLLGFTKREMVHISRKVIADSLIISNFLEVY

SEQ ID NO: 1492 - protein, 1198 aa, Reticulitermes urbis
MMADYNNSVDHALEDDTRFIFARDSVLARVCGHFDNLKCELCGVLLTSLQGVREHCHRSHHNLDLTFQCTKCDKGFSSYRGICCHFSKCRGARISVSEGPLSCSECERKFDSKRALSTHERHMHPGIRNAKRLKDFNPRGGGKTIHGNTKWTEEEVQLLVSLSKRFEGYKSINKEISLILTSKTCKQISDKRRYLNLHNGNGGLAAAEAVLVFCDDSHLEVTDSDGAVLSEIMDEEYYQSSLTMRSSIVHGDIGREVQGKDLVRIPPDNSVMGNCVVLLRKLATEKRSDLDLSKDKELRIDIEKATKANRESADGRVIQSVADNEIDPDTFQWKELLLGQVRGFPRVDENSELFDLDDKLTSELSSDSPVWNDNCELIVSDLCHVLCKNKYELGRQHHVRKGKRHRGIHHKREKFRECQKIFRKSPRKLAEYLYRDKDLSHISKDVSTPQGIEQYYSQLWGKPELLESNTTEEMLPSSSLFDCLPPITPEEVEGRIHKIRPSSAPGLDGVGKIHLVGKGITLVLAKLYNLLFLTGGYPECWKRNRTVFIPKIGKDLSEVGGWRPLTIGSLLARMYSAFLERRIRRVTSLSSSQRGFTNIQGCHVNLTILKEGIRQAKVKNGGVIVSVDIEKAFDTIPHSVIFSRLASQGVPPLLRKIISNMYKDVYTVIEGQCIPIKRGVKQGDPLFPLLFNIAIDPVLRSLEEFQGGLPLGNSAIKILAFDDDIILGASSAGQAQQMVDMLGIGLTSCGLGVSHRKCFGFQIVNKNKTWAIVDPMITLNGSSLPFSGPEDRLPYLGVDTNPWDRKSRYDAGQRLISAAKRGSQLSLKPQQKINLITTFLLPKFLYILIEDPPSPAYLKSIDHDLRQIYKNILHLPNCVSTAFMYSPKRDGGLGLPRLSCLVPLAHIKAGIKLGSLQDSLVREITTSDRFVRTMGSVSHSIGASWPLTLQDIYKLKSALKRREAKAWESCVSQGQGAAQFRGDSIGNNWLHNPGTFRPGQYIEALKLRANSTGVRVNLKRSGYNVPITCRFCKDIPETQAHVLGLCPKTKGMRILRHDSIVNRVRDKLKTKSPVALMHEQNFTVEEGQVFKPDIVTILGEVGYVIDVTVRYEDRDYIKDASVEKIRKYEALKGYLKDLYPQLNKVEVLPLVFGSRGAVPGSTVHNMGLLGFTKREMVHISRKVITDSLIIISNFLEVY

SEQ ID NO: 1493 - protein, 1009 aa, Rhynchosciara americana
MSNYNETNTSGGDNPRMATQTTGSLSSGPINQHTCELCCRTFGTRAGLGQHVRKTHPIESNQSINVERKKRRWSPEEIRRMANMEAQATINNIKHLTQYLATYLPQRTLNAIKGRRRDAEYKELVTGIIANLRSNSSTQQTNQVCNESEMSQRSKILQSIRESVRDLRSRRNKYAKALQELGEAALCGKMLNEEQLIHCIKSMFNTAKCPKGPRFRKTATHSGTNKQQRQQRYARVQKLYKMNRKVAAKMVLEETDKIQIKLPDHDPMFKFWESEFKEGEGMPERMPKDLKESPDLKAIWDPVTEEEVRKAKVANNTAAGPDGIQPKSWNRISLKYKTLIYNLLLYYEKVPHKLKVSRTVFIPKKKDGSSDPGEFRPLTICSVVLRGFNKILVQRLVSLYKYDERQTAYLPIDGVGTNIHVLAAILNDSNTKLSELHVALLDITKAFNRLHHTSIIKSLVGKGFPYGFITFIRRMYTGLQTMMQFEGHCKMTQVNRGVYQGDPLSGPIFLLAIEKGLQALDKEVGYDIGDVRVNAGAYADDTDLVAGTRLGLQDNINRFSSTIKQVGLEVNPRKSMTLSLVPSGKEKKMKVETGKPFRANDVPLKELSINDFWRYLGISYTNEGPERLSLTIEQDLERLTKAPLKPQQRIHMLNAYVIPKYQDKLVLSKTTAKGLKRTDRQIRQYVRRWLKLPHDVPIAYLHAPVKSGGLNIPCLQYWIPLLRVNRVNKITESQRSVLAAVGKTALLTSTVYKCNQSLATLGGNPTMLAYRTYWEKELYAKVDGKDLQNARDDKASTRWNGMLHSDISGEDYLNYHKLRTNSVPTKVRTARGRPQKETSCRGGCKSTETLQHVVQQCHRTHGGRTLRHDRIVGLLQHELRRDYNVLAKQELKTGIGLRKPDLVLIKDDTAHIVDVQVARCSKLNESHVRKRSKYDKKEIEVEVKSRYRVSKVMYEACTISYKGIWDKQSVMSMRRLGVSEYCLFKIVTSTLRGTWLCWKRFNMITSVRS

SEQ ID NO: 1494 - protein, 1455 aa, Ciona savignyi
  MOD_RES (916)..(916): Any amino acid
  MOD_RES (1141)..(1141): Any amino acid
MAGHKITMSEGKLLEVAVRYGGVRNVSYECPVPDCTKTFSQANNLIRHLNNFGNTKHRAHNFTYFFTCEKCKIQIHSNTKHNISNHYKQCCATGGGPSCETGQYFCPACEQAGLGNLESALRHFQSSHPEFNLPPRSQFSKSHPNSYTLSLKPKDHLMKILYSGPLTPGQLVCPIKICLRSSAARLFHDVSKLRKHMLVDHNRTLVYETTCGKCLRPVDTSKNMRKTTSHFEKCSGESFISSPSPIPQKTYKLDLPSTSTPPPRKSPKLQPYKPIRTFKNPLTKSSQSKSDNPPKPTPFFSPRTLERSASWPALSEVVDPLPKLKEKHPSLPCALDKCPPSPRIKPSTLVPPCHTANNSPKPTSPESPSTLKPLPRPIRPSKPLEDWLTVRSVGPDREIVLNIGPRPRPGPAAGSRTTSPPSTAPAKRVAANPIAAPLSGEPGATLDCGQTGRKVQPPKKRPTESAGSLPPPAEPATDLLTGREGLARLVEEYHLSGDFGAFCRDLERWTALSSTNRRPKPRRGRYNRGAAARATRNRGRDDRQDPQDRDDQGGPGPVTCGRPQRYKRAAALRSAFGRDMKATVRRIIDGERGDARCEIDPKTIEGRFRDELSPPVREGPECSLPPWMAEAQAGEHAPSNDSQPGDAYDGPITALEVEMVLSTLNVGSAPGSDGLSYGFWRALDPKGLVLSELFEVCRIERRVPGPWKSSRVTLICKDAEGDLDDLGNWRPISICQTVYKIYAAVLARRLQSWALDGGVISRSQKGFMPFEGVYEHVFLLDSVVADARATRRSLAVCWLDLRNAFGSVDHTTIVEALSRFGAPAGLVEMISDIYTGGSCRIRTRAGFTPDIPVGRGVRQGCPLSGIIFNLVMEVLLRGVEANNACGYRLSCAGGASVRVLAYADDVALVGSSRAEXKIQLGVCERFAAWAGFSFNNKKCAAMVLKHQRGGRRLLDSAPLRLCGEEVAILGPDSFYKYLGAHTGYGRQTGGQLVDRVERQVVRLFTSFLTPTQKLSALKRIVLPAMSFHLRVRPCAEGHLRRLDNTVRRCVKTALRLPKGSCRAFFHTSPDAGGLGITSVVAECDILTVTQAFKMLSSPDHLVSLVAKGRLGMHAARMGRSETASACAMADYLSGDSVMGHXSWKTGYRMPADLWTATRAASRRLSLRFSPQPQGEFGLESGTFKIAPRERRSLTRRLHHRQNLWWRNQWAALPNQGKTVAAHSAYAASNNWVKGPSSLAPQALFFGLKARLNQMPTRSVKACYSRAPNYDKSCRRCGAEVETLPHVLNHCPKSMKSILERHDSVLAEVLAAIPRGTFASVDVDRTSREHFRRVGEALRPDIVARRHDGSVVVADVTCPFESCASALDTAAARKIEKYDQLCANLRQLYRKPVESHALVVGSLGSWGRTNNTALAALGIRGAVRSRLAKQLVNLSVEGSHNIWLRWSGGIPKDLVR

SEQ ID NO: 1495 - protein, 1196 aa, Bombyx mori
MLRRGRIFLPASTKAGKTRGRMKWSREVNLFIMRTYYYVTKLETDLTIYRKKLHEHFSLKYPNVIISQQRISDQKRAIERNKLLSQETLDRLKEEVRKQLEDEQTNNVENEKLNSETYSHEYTTLTPQTILTKKTQQHTNIISSTQTSHSSTQTESITLLLENEVDILNTNPTEGATQTQEVKDKFETNLTMYSGMDPKARPPLPKLKYSSKLNELIRLFNNDILVDYISPDTQLSDVHTLTYCTAVTISEQLKYKIIAIEGNARHKKNFKPPWQQRLEKDIAKLRADIGKLTQYINNNRSKKVVQSVEQIFKNTKIHTSHENGNKKSQEFLDTLKQKLALKAHRLKRYNNSQKRKNENTIFLTNEKLFYRNLIKPKTDRDNSNIDIPTAEQLEMYWARLWENSAKHNDKANWITEEKERWDTIEEMQFDDVTEEEITTITARLHNWKSPGIDKIHNFWFKKLICLHKTIAKNLTDIISGNQSIPEFIATGITYMIPKGDFSIEASQYRPITCLPTIYKILTTVITKKINSHIEHNNILAEEQKGCRRGHMGCKEQLIIDSTIMKHATTKNRNLHCTYIDYKKAFDSIPHSWLIQVLEIYKINPIIISFLRNIMTHWQTTLKLKNPPNFVTTRQIAIKKGIYQGDSLSPLWFCLALNPLSHQLHNDRAGYRIKQQDNTETIISHLIYMDDIKLYAKNDKEMKKLIDTTTIFSNDISMQFGLDKCKTVHIIKGKVQPGDYTIDDTNTITAMEPSDLYKYLGFQQLKGLDHITIKQSLTSEYKKRINAICKTKLSGKHLIKALNTYAIPILTYSFGIIKWSKTDIEQIERITRTTLTKHNNLHPKSAIERLTIKRQDGGRGMIDIWHLWRKQIHSLKTFFYIKSDLSEIHRAIAQNDNNYTPLNLKQKELIDNTENLRNRNPQKDMEENWKKKALHGRHPHDLSQSHIDSKASNMWLKTGSLFPETEGFLIAIQDQVINTKNYRKYIIKDPTIRDDKCRKCNTQPETIQHITGACSTLTQTDYTHRHNQLANIIHQQLALKHKLIQNTNTPYYNYKPQTVLENDSCKLYYDRAILTDRTIHYNRPDITLQDKNNKVTYIIDIAVPNTHNIQKTFTEKMTKYTELKEEIVRIWKQKKAYIVPIIISTTGVVPNHIHNSLKLLDLKDNIFISLQKAAILNTCRIVRKFMQLEENQTYYTQ

SEQ ID NO: 1496 - protein, 1209 aa, Anopheles gambiae
METRSMRKRTTRLPEEGAPTGAGPGTGDRASIQRLEDEMVQERSFSQRALPVPRTQNRNGSPINHQGNAASANVAVADRQQSLILAGGRRQRIMWTREMNHYVIRCYYVYTRMETDMPGRVKMLGMFNDRFPRFAHQLDLSKLYIRQRAIILPEELEFIKLEVRREFGEEEAGWRESSRISARLNTIDQNTSRASEDRDLDEPTAPGLSVDIQHQMATAVTQFHGTDPLSRHRLPKLHYSYRLKTAVSIINQDVLPQYLDSVGSIEDLQLIVYSAAVAVVRTLWLRTYPQGDSEGRPCSKAEKPAWMRRLENRINATRTKIGRMQEYQRGNSSMKVVRQIAEMVKPKELRDLTDANITEVLDIHLQRLSALAKRLRRYAECSKRKEQNRMFNINEREFYNWIRNDKPNFREGLPDIGDFTQFWANLCEKPVQHNSEGMRLAEDERFSDGIEDMPVLVVNAQDIREATQYTRNGAAPGPDFVYNFWYKKLITIHEQIAACFNTVLEDSRKLPKFITGGVTYFLPKDQNTKNPAKYRPLTCLSNLNKVLSSVITQKVKDHCDTNNVMTEEQTGRRKNTQGCKDQVIIDAVIVGQAAKKQRNLDMAYIDYKKAYDSVPHSYLLKVLQLYKVDGNVIKLMQHAMGMWSTSLHVTDGKVVLRSRSLNIRRGIFQGDTFSTLWFCLAMNPLSRTLNQQCNFGYLLKSEEISTRITHTFFMDDLKLFAETVQKMHHLLKNVQGFSNDIKMEFGIGKCRSIHLHRGQVLDADSFRANEQEEIRHMVQGETYKFLGFLQLRGIHYAVIKKELQDKFLHRVSCILKSFLSVGNKVKAINTFAVALLTYSFGVMKWSNTDLEALERTIRVVSTKHQMRHPKASVERVILPRKIGGVGIIDIQALCISQIHQLRSYFVESQNRHELYRTVYKADHGLSALHLAQQDYQLNCNIKTVDGKGATWKQKELHGTHTHQLNLEHIDKVSSSTWLVRCDLFCETEGFMVAIQDRVIATWNYRRCILREDVEDRCRKCNSGGESIEHVIAGCPVLAGSAYLDRHNDVAKIVHQQLALRHKLVERFLPCYRYLPDPVQENDCIKLYWDREIITDILIRANRPDILVYEKRKKRATIDIDIAVTLDHNVQTTFSTKVMKYHDLAEELKQTWYLEDIRIVPVIISATGIVPMALLRSLDELELQRELPRIQKAVILRTCSTLRRFLNPYN

SEQ ID NO: 1497 - protein, 1281 aa, Bursaphelenchus xylophilus
MTCNNAVVFPPADGNPAGTADRNFAIRFPSSEPPGPSGIRPSEPLDGRTGIGDVEHAQAGNGGFLVDVLEYKEAHRYGSKCEFCYVQTKGTVCSKPRTDAWLKCEILFLLHHAYTANQNKSIELAESAFRRAGITRRSKATIAKRWSLIQRGKGTDYKEYWDEYFEKFRYECNPTPIVRRKRNRLAAGLQSPSSVPNGYEFERKRTCETPLDTKASSLPLICNLLTGIVGVENVEENMSVECTEPKELSGTANSSVPGLAEGVYERRHNNVNEPAAGCPQDVPVANNLIDSPTTNDRLEAEFKAQLDRAERSYMRRRLPRLKNLSPDERMWIGTTVERLRLETVSEPVCEQWRLANAGLYAAIRSIAVMRPLDAAREAHKTWLLNMKMTERKLRQQIGWVETTRRTKNEARTERQEIVYRKVAKLRRERFPEMDLDSVSVHLKRKLELLKGRIQVRTAERLRRDTREAAGPYGKTALRGQGFAPNVKDATQYWSGLAQPSGQKCSENSAILSDWKELVECNLSSLPDQMEPLVVQGISRASPWKSPGPDGIFNYYWRQDFIVDWLKQLMLDSLRTGHYPWKLSSGRTVLLYKDGDPTKAENYRPITCLNGCFKMINSVVSEVILKRVENTIALPIEQMALRRKVWACVESQIWDQIKQRKLSDRTQKCKVAWVDFSKAYDSLNHDAIKFVIGVLKLPTGINNYLLDSMQNWSTHLELKSSGKVVRGPSYPIKRGVLQGDSLSPTLFVVVTSIIVRHIKTIESSDIQMYMDDIKLYGKDQETLTRLIKELQTVSNKLGLCMNLKKCAILGDDLPEEINGIEHLKESYKYLGVPQREITQVRATMAALEKKILTEVDTSLGAAELSYRQRISRVNSKIAPLVRFVVQSMLVTPRDVLKVYNRLGGIDVEIRRRLVKYEIRYKKSNVARLYLDRKVGGIGFVNLCRIMVEAVAARAVYCRLAPSFNEFQDFLAEQNTSPITAAQTILDKCGINIELSTSTLGDVKKIVRNHYHELWLTAWKNTGLYKRWENDHVDIKRSSLWINRGNLSANNARIGIGIQDNSIFCRGFVGNKCDTKYCRLCGDGIESVSHIVTGCPTHRTNLYIERHDCVARNVYAYLAIRYGIPVPHYTQRVKTIEKNGDQSVELYWNYKFPCTRALEACRPDIVLIDKVSKRTHIIEVAVSWRGRLQEMVDRKVYKYTVNGEYEADGSSRGWNIVRELNDQYGFPVEVYTLVIGAGGEILPCTVKDVERLTGGAATDNLIERMERSAVLGSCRIIKRHLAL

SEQ ID NO: 1498 - protein, 1354 aa, Heterodera glycines
  MOD_RES (69)..(69): Any amino acid
  MOD_RES (444)..(444): Any amino acid
  MOD_RES (854)..(854): Any amino acid
  MOD_RES (907)..(907): Any amino acid
MISCDLERETLTQMALFRARSDKTPTHAGIPAPDEVREGGCGQNRTNPAAPRGKAAAIQRQNGITIPIXACAQSGLVRTQRVQQWSAVEESALKDVVVRNTDDRGLINWAKGVLPEWQRLCQLNPTMYMARSSPSLSNKWASLRRTHVGPGCPSKEGSGPSQDLSDVKIQPARLAHDTVAELPQRTVPCGTDGHGVIDSDETETALAEVSRSSPFGEREPLDLGATERITRKRLRNAVRDVVPPRKRRVPSTPSRKEQDLVPEVDGPAPTDVLTHPPTESEPEPMLDPLSLVQLVRPQLGRAMGWAAEEMELGNVVMDVELKREFNREVRRVGRTPPDQMYKRGAGPPLPQKREPERVALLEQLIAARVERGINRGLDWFLELNVAVFAAARVLSRRERVETLADRLHINDSATLSEVSRRRAKAERKLRCAREQPWMSRRIRXLGVRVERLKQLADLVRQRIAGRGNRSSYEGPRRRFRLRPSLRSVTEAPVNPPLNGNEVYTFWHSLWAQSLRANTDDCQLREFKNQLSAARHTDLTSVGTSSLVQMFSAALRKMKKGKAPGPDGIRAAWWGVFRRIAPYVATWVVRVIRGAEPVANWICNGLTVLLPKSSDNADPSNYRPITCLNTCYKLFTAVIAQITASYVDVLGGLPRQQVALRKGVWGTSVSLMIDALTVADARRAKRPLGVCWFDFKKAFDSVPHNLIRWILRVIGLPPVILSVIVSVMDQWATRLKIGGKVMPKTIPVRTGVFQGDTLSPLLFCLSVWPISFALDQFPQYQFRCANHLQQGFSVGHVFYMDDLKCYCPDREVLTAVIQQVQKSASALGLTIHYKKSAWLDQDGGKSGKAVLGVPXLVGTYKYLGMHERFMIVSKDSLESVRGKFMGRLKTLWTSKLTFGQAMLGTKSXCMPVVRYVLQNLFLPKSEFNQTRLVLREWDRQIRDLLDECNIRQVFRSKTELYVSREEGGWGLPSMEDALEEEVVTKLAILVARQETEPLFRVCEALERKRCPTPLSLGLQILKDWGVGVELQGRTLLLNGNTVGPSQATRKLTGELVLRREAERLSRWRSKVKPGCGMTGGAWRDVPGIDVHLSNRWLVKGALSPTVVSNSLAIRANTVILRGSGGGYTKGTLLRCRGCGNTGETRRHIVSACSLGRQKGAASRRHDNVCRILVRAICHKLNIEPPNSANFPHVVVLEGSGAKMWIDFPFVVPHKIRHTRPDIVVLFEWNGVRRLSVIEVAVSDVANMQTQHIRKSHRYGTNSTEPFVAGVTPTYRNDCLAAQLRAKFKAQQVDVIPIIVGTTGETLDGEFGRIRKGLPMLTKLQMPRLWSEIQRAVILGSYRILVEHLALPKGGA

SEQ ID NO: 1499 - protein, 1284 aa, Parhyale hawaiensis
MKMSHNRDTPSNGVKGTSVRLGTSLVRSPVGEAGAVRERGTHPSESVSQDSDASVNATGEGSVREQAPLSPPGAEEATVPTQRRTRHKWSREDRVVLWECFVASKREGPGYLKRLKQLWDERGIPGNFPQASLSGQIRQICSKNLLSEEERLQIAARMEAQVASPSADEPARQVPTRPVTPPRSPPVEPARRPSIPSEETPDLGAVPSEIDSADPNRSPSRGPRHLPAHNMSQSESEDDVTDPDVSDQQRSDSLEPRDLLRNSSVESTPGHPNQELSDTLLSNYVPSEIDSDDPNQSPRRGPRHLPAHDMSLSDSMDEETEPDLSDQQRSDLLELRDLLRNSSVETTPKGHPSLRHLPEPKIRAAAFRVNSVIGKIHTNNITETNALIKAGADLAVRILEVQPRPQRTQRKKDPPWKHRLEKNIAEIRKHLSWISEWRRGNLHDEEKKTLLESRYRCLEVGLTNLEDTLKQRLSAKRSKVRRFEARVAGFHQNQLFNTNQKRLYQTLRGEETSSDSPNAEESIRFWSDIWSKEVRHNNTAEWLHDVKEKNVAADPDLTITSQQLKKQLSKTKNWKAPGPDMVQGYWIKTFTSLHSRIAAQLNHCLQRGTVPTWMTTGKTVLIQKDKAKGTEVSNYRPITCLPLMWKVLTGIIYERVYQHLDSKKLLPDEQKGCRRNTRGTKDHLLVDKLLTKDARSKKKNLSMAWVDYKKAFDMVPHSWILECLDIYGIAGNIRNLIATTMPNWKTQLTSANKHLGEVSIKRGIFQGDSLSPLLFVLTMIPLSETLNKAGQGYNYSRTMKLNHLLYMDDLKLYAKSKDQVEQLLNIVHQYSQDIKMQFGVSKCGVLNIERGEVTASEGITIEEGTIKDIEEAGYKYLGVMEYNTILHRTMKDSIRKEYLTRLRLILKSHLNGGNTIKAINTWAVPVVRYSAGIINWTKKDCTDMDIKTRKLMTIYRALHPRSCVDRLYINRREGGRGLISVEDCVEAEKRALSQHFRESDDPWARCLVEAKLLKETETADQFKERRRLDRTNKWKSMKMSGQYLEAVQDKIVPDSWNWLLRGELKRETEGTILAAQEQALRTRYIQNKIDKRNVPSTCRICRSSDETINHVISECGVLAQKEYKRRHDKVARHLHWTLLRIHNFPVSERWYEHEPAPVVENEAVQIYWDKRMETDRVLHANRPDIVVKDKQEKSAKLIDISIPFDSRIVDKEAEKKEKYRDLAIELQRLWQMKVDVVPVVIGALGAMSKNLKTALRELKCGHLHPGTLQKSALLGTAHIIRKVL

SEQ ID NO: 1500 - protein, 1261 aa, Bursaphelenchus xylophilus
MVFNNCKPKHLCPAIRPTGQQETNGGSEGTAEPTAGPSRPAVSEDAAQPVPLFEEGEYIRAHRDKTCPYCEVLWIGARSSKARSDSWPLCQILYLMKRNDDLRGQRTRYPLLESSLRAAGIARTKFAIIKCIRNVLRDRYVPNGPYSEHWKIYRANSGEVPQGATITKGKRSARVAGLPSPSQSGHHTKRIQAGTGIETETTVTETNTTPEVSHEHRDPCGEPETSAANVDKVTELTEDGSETRGTANVANGGVSVSDPGRKRQSSSQNRGNIETTNPELVGMWEDMFGVQLDGAMRTTERPRLPKLKHLSEPERLWIRAKLEQAWLQCVSYDVEQQWLNANAVLYAAIRSVAASRPCKEAREAQKTWLDNKKKDEAKLRRLIGRISSVHSMPKGDRTPREKKLVKNITKLKNTHYPDMDWGGLLNHFKVKLSQLKEKISVRVAEHKRKVNRNAAGQYGKSVAGSAGLAPDVVSATAYWSGLAQPGPKKFKASSPIFQTWKDDVAKNLNTEPVLLYPIIKECIRKPSPWKAPGPDGIYNYYWQQEFVAQWIQTLVKRTLDIGRFPTALMCGRTVLLFKSGDKSMPQNYRPITCLNGCFKITNAVLTKVILQRVQDTCALPREQMALKPKVWSCMEAQLRDQALQSEIGDDCKTAWIDFSKAYDSLDHDALRFVIQTIALPAGMEEYLLKSLDSWRTQLVLSDAGKVVSGKPYPIKRGVLQGDSLSPALFVLTTSPIVAHLQRTCPTGRIQLYMDDIKLYGKTESDLCMLIKETQRVANKLGLNINLKKCALFGKSIKQSIAGFDPLGDRTYKYLGIPQRDVADIKQAYDELKAKTVQTIGETMACDYLTTRQVINRLNSKIPPVVRFVTQSALCSAPMTRGLYNKITELDNVSRAELRKVLIYKATNVSRFYLATKEGGFGYASLQQVFVEAVVSRAIYCLRAPSLCDIREFILSKFDPVKVARIALARSKIDMDIERMDMASATRTIRQHYQAKWKTLFQQSKLYQKWVQHKIDIPNSSRWLQRGEISPRNCRIAVAVQDNTLLCRGFVGSKDPNKQCRLCNAGIETASHIVTECSTHRVHMYIERHDSVARNIYAVLAKNCGFWIPHYSQKIPTVKITKSYELYWNYKFPCTQALEACRPDIVLIDRAKKRILVVEVAVSYVTRLEQMTQRKLYKYGVNGEYQADGETRGWNICRELVQKYNMRIDLCIVVIGACGEILPCMVKEIEKISKVSGRQLLERCQRSAVLGTVRTVRRHLAN

SEQ ID NO: 1501 - protein, 1360 aa, Heterodera glycines
MRKSFLQHIPELSSHIAMSVPARNYPKMCSLAQGSSGTLSHNGKGVAMHRCPSDDCAGKDPPQRGSQKGNLRSVRWTPSEEKAVFEYWSRLEQHAMLNGSEARGTCAITRSQFLIHWDGERESRSLSDGVPEYPMRTERAYYERVRLLRQRGWQWDCANECLVIGQCAEPCRKPNVVAIKADKGMKRSLVKGKLLSLPHVMGEINQVSVQVEVPLPSVPASVPQVEGVESKGFTETEPSNKPSLEGNPAEEGLRKPERVNVPVHGIISDSERKDLKDRFWSAYKTAKRSVGFRPALKIEPNRVNRAQWEVLDSCVVEVLKKRETSNGYRGCVLRHLNVAVYAAGYVLAEGNKERRQVIRRQSAEWLLRQKSEINNIRRHIGWITDELTRRRTGKNPTSRQLSNFAWLQRRYQVLGKPVRETRDLEVQRERLVSRLRLAQDRINSSMDREERVRKRMLPLRRKLEEPLGDSKLDTKQARTFWASLIGERKEFGKIPELENWAEEVRSKVTDGQGFASDHVDQTVWKKILGKARPLKAPGPDGIPNLLWKRLPSANQALFKWLMGIKRKQLSVPSWLTKGRVVLLPKGGDPVDPANYRPIACLNTQYKLVTGMVTAWVSEHLTTYSILPIEQRAMVSGTWGCTHAMVIDRAITSYAEATGLPLYVGFVDFAKAFDSVSQPWIRYALKVAGVHKRIRCLIGILMKCWSVRYEVFKSGRVLRSAPLAVKNGVLQGDTLSPLLFCLSVAVVSSAVGSLFDFEVTIPGRGVMQQQNHLFYMDDFKGFAPSEASLTRMLVTLERTASALGLKINKRKCALVHPRERENEETGSDIPVLGLRDTYKYLGIEERFGIVFEDAWDRVRTKMFERMRTLLCTEHTFGELRAAFASTIAPVARYLFLNVIVGGPSWSETLTKAKDMDLRIRRLLWERRDNEPGWRFKHCSADRLYLRVQYGGLGFVSVEDTLSESIIYCWAYVQCRPELELARELFGTLNRSARSGIKQSIAKGARKVFRSYALLSKNSAQRVSDLDGDASPGFRVGEMIFMEPTRGARAIVKILRKENDSRRLAAWKGRPMGGRVVSLPELDQVHSYHWLIRARIGRRSFRDCIAAQEGQLKARELMCPHINAKAKWCRRCGDGRVETEQHILSGCAWSRTGTMLDRHNGVVRQVHTALCRKYGLPVSSHVVPLHAVIENEHAKILYDVALHTSPAGVLPREDGSTSYTGLRSTRPDMVIFDKKARTILIVEISVPWRENLVKQELIKWRKYAINSMIEPLELAEAEIPGPNLKHALGLAYGTSFPTVKVVPIVVGSCGEVLPNITKRLSELGIPKRGIPSLLESIQRAAIIGSGHVIRAHLSVPRSESET

SEQ ID NO: 1502 - protein, 1000 aa, Strongyloides ratti
MQKFSVPKDSSQIFLVDSILNKHICSTKNKVKDVIKRRSIIKTLICAAGLTLRKLVCGKLGNNKYNSKINQLWKKERKIINCIEDLKHLIETNKRRHNFGKRLRNAKVSPSEMLKDYYNKLRYIKNEITACLDEHKKAILRTKFKLTPSIKIISNIQNHNDEEAELPKEEEFVKYYKELFTNKDGDDKETPHLDNWLKKFSKTLIVDWTINDKEILEALKYCGNFKAPGSDMVMKVCYKWFKSAQNYLIRWIKSTWYGEYTINKKDTNAVTFMIWKRDGKPKNDVKSYRPISCLNCDFKLLNKLIANKIYESIEKILPINQMAVIKNKHGTCEALLLYKSLVQSMKFRRTKDVKEIWCSWIDFSKCYDSISHKCLKKMIQSIKAPPIIHKLILDGIDSWNISICNGKNISKTKIPVKSGILQGKVASSLYFVLLTGEISYALNKEEQVPIETITPSNTLKINHISFIDDYQLYATSQKKVEKLTIKLREIAEEMNLKLNPQKCGIYGTDDLGKRLMLKESSLNFPYTSEYKYLGLVENSLDLKDINIQLFKDKILSKYSTIFESRLTTHQKRKVFNSTISPCAAYYLGNLITNKCSIQELLNECKKFDQMVRNQLVNQNIKKLQVSNSRIYLPKEYNSLGLNEIEIEVAANIIRKACYIKKRETLRGVDKLYIAMSKNGHRNTLSDALYITKKYSNFQINWNIMGMVKDQNNILLDAKKIIENIKEKRRNLWLEHWKKGNMTYANEAIKKEFHLPDLNIDSKYLMLCYAGSEEQIIYNGHVSLVNQSSPSSRLCRKCNKLEETSYHVASVCEFHKKNLHLMRHNSAVYHIITELCRIMKVKCTLRYPEASGIIKSGNMKIAAGVKYTFGTAKIYHNKPDLVWYTPEVIYVIEVSISSLKNAKSQMKMKTARYAVNSTKKLENFAALNNLKKGENFVEILSHKANFKRVHFMPLVFCTFGEIPKETMKYLEKLNFSNEKIKTIASPIARYTGRTLKAHFTN

SEQ ID NO: 1503 - protein, 1292 aa, Bursaphelenchus xylophilus
MISRSQADRPVEGQPVTAMSFHNLEPNNLYPENLRPTGSQDANRGVADIAEEVTGPSGLVTNEEAARAPPLFVEGEYKRAHCGGGKCHYCRVLWIGARSSKARTDSWNLCEILFLINKCMELGNVRRIYSPLESSLKEAGINRTRHAIVKCRLAVMRDRFVDNAPYSEHWRLYNACAENRAVVVPMDSATTVKKRTARQAGLESPSQIGVAGKRVHEAETGTDRINAVIETNTTPLEDIDLSPETPEGLAELPSTVEIMELTEDGSRSRGTANDADGGVSISDPLRNRPSSSQESRNVPEQVDPDGELVWESLYGAQLRGAMRTTDRPRLPKLTKFSAAEQLWIKSKVEKARLECVSYGIEQQWLRASAVLYATIKTVAACRPYNKAREAHKVWLENKRAEEKRVRRIIGRIETVRTMPKGKRTDKQIRLARKINRLKRVSFPEMDWHGFLNHFKAKLDLLKKLISVRVAEHERKISRKIAGTYGKSVSGQSGFTPDVVAATTFWSGLAQPGPKKFKKNSLIFQTWKDSVVENMNTEPVLLHPLIIECMNKPSPFKATGPDGIFNSYWRQGFIANWVKSLIQRTIQTGEFPASLMCGRTVLLYKNGDTAKPENYRPITCLNGCFKMTNAVITKVIVQRVQDTCALPGEQMALKPKVWACMEAQLRDQALQSEIGNDCKTAWIDFSKAYDSLDHDAIRFVIETLALPDGMEKYLLKSLESWKTKLVLSNRGKVATGRPYKIKRGVLQGDSLSPALFVIATSPIVSHLKRVCPSGRIQLYMDDIKLYGKSETELRMLIKEVQKVANKLGLQMNLKKCSTYGAGLTESIAGFDPLGDRAYKYLGVPQRSVADTNLAFGELEGKVIRSIEETMACEYLTMRQVVTRLNSVIGPLVRFVAQSVLTSQAKVSWIYNKISDLDSKIRAKLAQTGLRYKKSNVARLYLSKSKNGIGLVNVQQVLVEALVSRAIYCLRAPSLVEIREHILTAEFDPVGAARTVLRRSRIQLEIERVEMASAISAIKTNYQARWMTKFTQSKLYQKWVHHDIDLANSNLWLERGEISPQNARIAVAAQDNTLLCRGFVGNRESEKQCRMCNMGIETCSHILTECSYHRAHMYIERHDSVARNIYAVLAKDHGLWIPHYSQPVSSVTKTPTCELYWNYKFPCTRALEACRPDIVLIDRAKRTILIVEVAVSYVTRLKQMVSRKVYKYGVNGEKGADGESRGWNMIRELSEVYNMKVNLCAVVIGASGEVLPCTVKAIQSISSKTSSRQLLERCQRSAVLGSTRVVKRHLAEFH

SEQ ID NO: 1504 - protein, 1177 aa, Bursaphelenchus xylophilus
MEILWEDLRLKIEDRYGVTLPQRSASSLKNQYPKVILRGLPDSGLPWAGVQVNDTGQVVVVDHAEAATLRGSSPAAVDGEAEEPVVPPLPAAEVVESAADAAVPDPQSEIVADQGVETRPVENPPANSRETETEPVEVEPYLEGQYKFFVSKILGKSMWRKPIKYPRRVPETLWRQANELIERSIRQGEVSIQSLNCMVYAAGCAVKSSLDKKDQEAKRRESEWYACRKAEIKALERYLNFIDLELKRRSASRPLTSRQRQNLGVLITKYGRARVRSGVRLSELQAMLRDALVGIRKCMAKRSADKKRKQGKFVPIQRYLEPSSAEPRLSPDTVRAYWNDIVGSSQQSTSDSTIQDWSSNLSVPSQELNASKIMGWWRAAVSKSKPNKAAGPDGIPGVLWKRFRSASEWVCTWLYRLLQKRRIITPRWLSVGRVVLLPKKGPLEDPANYRPIACLNTVYKLITSVVEMAVREQIQACPGLVPYEQIANRKGVWGCTHASIVDRMITGASREGKGGGFPDLRVLFYDCKKAFDSVNRDHMFAVLRVANVNVKVVHLLHTLSQQWCVRYELRRNNRVERSSPLRVKRGLLQGDTLSPTWFCLCMAPISASIKTLNPGPTLRPNMGNGRNRGQVAIQVSHVFYMDDLKVYCPRVADQRRMEQNIPQLFGEIGLSINASKSAAAAAVGRYVESELPVLGTKDEYKYLGIESGFVVNEVAALDRMQAVLLNRVEAILSVKEHTVGQRRDAIRAKAIPGGAYILGHIILSDLDPRGAAERMRRLDIEIRRLVKSAGILHDKCSTARIHLSCEQGGLAWPSMERAYYVAVAYSASYLLTSQDETISRARDYFVSGRLSNKFTVYKHLTSIVDSLGLSVELPDPNGLPTGQPSVLARTIARAIDAKLEAQWKETLLTYQRAGRVERADPTVVDHANSYHWLRKAWINEKAYQHAVSVMEGTLLEGVNPHGVLTMCRACKAPSASIAHIITGCAELRKSHMKVRHDGVTRWLYNALTEVDGSLPKFHYTQQIPAEMRGERLTVRYDSDIVTPNKPRHNRPDLVVFDSTRKVIYIVEVSVTWLSVLQKQYDNKLNRYAVNSNHEFSESIPYPPGVNLANEIRVLYPQFTGGVKVFPMIISPTGEVHMQFVPHLAELLENPNIPRILEKIQRSVVLGTDYIIRSYFAM

SEQ ID NO: 1505 - protein, 1353 aa, Ascaris lumbricoides
MPCSTNSFFERGTPEPHREPISGTDSSESLGMGTHRSPRLNDDEVINGPKGHESDPVHVVRAPRTLHPRRLELPIGVNNLGEASQLRQDSAIAEEAQLESTENHDGRRPPLRGGRKLWSEKEIATLRRLCEAYGNRQVCWKEVQRKFADFHEERTVAALATKWGALKRPRAPMVGAPPTPDHDPERGPAGEGDGGTTSQENVPTDDPIPANGPTEGKESDVRPAVACRCTEPEEQLMESDVRPPAVVRLADPEQHTMKSGVKPVALDGSADLEERPKEKDIEQMGVDFEGEPRFRAFRKAFYGYFRWAVNSFDREPVKRVRRDCPKVFYAYADYLIATGSSKALGPNQSRIGRLNGLVYAAARTIHQFWREEVGHRQQGEKGWYTKTKATREDLQMLISMMESELARRKEKRKPGAKELENIHKLVARLGTRSTSGIVRRLEMTRQRLKLLEDRISLHEQEKRRKRLRKQFAETPSLKLLTKGAKDRGDTMVTMKSVMDFWRPIIGRRVTSNPDQLQVLRDWRDEQKKAYPADLDLEKADLEEKYEGAIRRIQPWKAPGPDGLHAHWWKALPSAKRLLGELVVDWLTTGKVTTGWMCRGRTILIPKKGDRGDPSNYRPITCLNTCYKVLTSVMNSVILSHLSRGEALPMNQRAMRKREWGCTHAMVLDRAMVMDAMAQKKHSLSVAWLDYRKAYDSVSHEYIRWAINSVNIPRSVQLTLKRLMSDWETRFESTQCRPKLRSDKMKVLNGIFQGDSLSPTLFVLCIAPISYALNKGVGQCQSSSGWSAGYGFEIGHQFYMDDLKLYARTPAMLDSQIQVVSEVSEAMGLHLNLSKCAKAHYAPHGAGGAQEAVEGAEGSRKGEIPILGLRSTYKYLGVEQRLLPMEVALKEFEDKFMDRAETIFASELTWGQMATAYNTIAIAGLRYVYSNTNGASPKLLEALKRAATLDTRIRDLLRRHKCRFRNSFVERLYIPRECGGYGLKSVEDTLRESILATWSYIATNPHLAGQQYFFERLAARGKRTPMADGVKILLDLGVEPQVDLKRRTVTVDGIVFEDPTKLHRYLVGKLLKARTEARIRRWKEASLAGRLVNDTSIDMRLSCLWMKKGFVSARNLRDALAVQEGSLLTRACPALKGKGGQEVCRCCHAAPETAEHITSACRYWLPSLYVERHDSVARNLYYVICCRYGITPVHYSNRVSPLSENSQCRVLWNMDMQTRTPMKHRKPDIVVFDLKREKILMFEVSIAHASGLLKQREIKINRYTVNSEELPDETITPYPPGPNLAADLAATYGWQVEFAPVVVGTCGEHVPAVKEDLQRTLDLKPHQVEALLERISRSAVIGTARVVRAHLACS

SEQ ID NO: 1506 - protein, 1368 aa, Heliconius melpomene
  MOD_RES (435)..(435): Any amino acid
  MOD_RES (572)..(572): Any amino acid
  MOD_RES (607)..(607): Any amino acid
  MOD_RES (611)..(611): Any amino acid
  MOD_RES (757)..(757): Any amino acid
  MOD_RES (1272)..(1272): Any amino acid
ITYTANMALVTLFMENMENKRYNLRPLPGGRRGASGANAGCHSMRTVGDGGLSRRVPLEKNVTAEQSSSPLTSSSSHSPVSSIPSPSSTRTLLNSPNSSPTSSHSSLVIRSADVVQEALANYPAPTAGSIRARKKWTDIMNRYIWRTYLIITKCETTLLNNYLEPLHQEFSSKFPEMQVTRQRIGDQRRAIIRNKLLSDDTLAQILIEVKELLQIGDQPLTQNNIHSTQLSHSNTRIKWSNELNEEIVKCYFEVTLLEVNKTSYRKNLYSLFISRNPHLSHLTEQRIADQRRLIFMNKSVHNDRIIELKREVEIKLANSNSLTKNITESNSPSSQTNEINDSAYVQSNLQPVEPLDQHCINRHNLIEKHYVEQEFNNALIQFNNTNPETRPYIPRQKSSRKFSQIVSFLNSEVLPKHLNNELDFNALHNIIYTAXYTASLCNGTKFSFIDNYRPRNSKPSWQRRLESRIDKYRLQIGRLTQYISGNRNRKILKTVEEIKTQYKIHSHHEEPNTELPHFLDTLKQKLNATSNRLRRYLTCTKRKQQNNTFVNNEKHFYRTLSSTNQNTTTQLXEHPTENNLQQYWANIWETSIEHNADAEWLNKIPDXEINXMKFKDISIETFNQIIQRTHNWKAPGTDNIHNYWYKKLTCTHSLLLKHINQFIQSPCTLPLFITNGITYMLPKGLDPTNPANYRPITCLQTIYKIITACITDIIYKHIDQNNILAEQQKGCRKNSQGCKEQLTIDAIVMKQAHNKNXNTMYIDYRKAFDSVPHSWLLYILKKYKIHPILITFLSSVMLSWKTRLKLINNNETLITDWIKIQRGIFQGDALSPLWFCLALNPLSELLNNTNTGFKLKHNNTYHIISHLMYMDDIKLYASNNKELKILADLTQSFSTDIRMEFGIEKCKVHSIKRGKSQQNTYILNTGEQIESMDENSTYKYLGFQQAKQIQQKQTKIELTNKFKFRLNQILRSQLNSRNIIKAINTYAIPILTYSFAIINWSQTDLSNLQRIINTHMTTHRKHHPKSCIQRLTISRLDGGRGLIDIRNLHNNLVTKFRNYFYAKAEISELHKFIVNIDNKYTPLNLNDRNIQLNQTLITKQQKIEAWSLKSLHGRHLADLSQTHVDKVASNEWLRRGDLFPETEAFMMAIQDQVIDTRNYQKHIIKRPNMVNDLCRRCYSSPETIQHITGACKTIVQTDYKHRHDQVAAIIHQHLAFKHSLITQAQKTPYYKYSPQAILESTNFKLYWDRTIITDKTVHYNRPDILLHDKVKXSVYLIDIAIPNTHNLASTFSNKIDKYTDLTIELKSQWKVQSVTTVPIVLSTTGVVPHTLHTSLETLGIHRLSYILLQKAAILNTCRIVRKFLSSNN

SEQ ID NO: 1507 - protein, 1136 aa, Takifugu rubripes
  MOD_RES (5)..(5): Any amino acid
  MOD_RES (131)..(131): Any amino acid
  MOD_RES (269)..(269): Any amino acid
  MOD_RES (354)..(354): Any amino acid
MSGTXTDRVIPARTSPGSTRSASGVGEPGPPDVKLATGTRHSWSRAENVVLMECYYGSNPSERGYMQRMWEKWVLRNPTSSLTKKQLLAQCSNIRNKKLLSQLEIDEARRCASPTVQICYGKGEPGRQVSXGVISSSPPNIEIGYKAPMTDGLGTRAADLRERIMKSWGNSTTSLPRLTHKVPDQSLLEDMNTALSTIPTTTITETNQLMYAAATVILQMLGYKMKSMNSQKEQMAPWRRRLEAKIMATRREVSLLTELSRGVNLRTEXPKKYNKLSTTEALETAKQRLTALATRLKRYTREVEARRINKVFSTNPAKVYSQWQGNKMTTDPPRAETEQYWKSIWEKEATHNTXAQWLQDLQTEHSQLPEQDPVVITLADIQTRVSKMKSWTAPGPDKIHAYWLKKLTALHERLAAQMNQLLTSGNHPEWLTQGRTVLIMKDPQKGTIPSNYRPITCLSTTWKLLSGIIAAKISRHMDQYMSRAQKGIGNNTRGAKHQLLVDRAIAQDCRTRHTNLCTAWIDYKKAYDSMPHTWILECLKLYNINRTLREFIQNSMKLWNTTLEANSKPIARVSIRCGIYQGDALSPLLFCIGLNPLSQIITKSGYGYQFRSGTTVSHLLYMDDIKLYAKNERDIDSLIHLTRIYSKDIGMSFGLDKCGRMISRRGKVIATDGVELPEGNITDVQDSYKYLGIPQANGNHEEAARRSATAKYLQRLRQVLKSQLNGKNKIQAINTYALPVIRYPAGIIPWPLEEIQATDIKTRKLNGKHKIQAINTYALPVIRYPAGIIPWPLEEIQATDIKTRKLLTMHGGFHPKSSVLRLYTKRKEGGRGLVSVRTTVQEETTSLREYIKKMAPTDRLLSECLRQQKPTKEEEPEGLSWKDKPLHGMYHRQIEEVADIEKTYQWLEKAGLKDSTEALLMAAQEQALSTRAIEARVYHTRQDPRCRLCGDAPETVQHITAGCKMLAGKAYMERHNQVAGIVYRNICTEYGLEVPGSRWETPPKVLENKQAKILWDFQIQTDKMVVANQPDIVVVDKHQKTVVVIDVAIPSDSNIRKKEHEKLEKYQGLKEEMERMWGMKATVVPVVIGTLGAVTPKLSRWLQQIPGTTSEISVQKSAVLGTAKILRRTLRLPGLW

SEQ ID NO: 1508 - DNA, 250 bp, Homo sapiens
ccggtcccccccgccgggtccgcccccggggccgcggttccgcgcggcgcctcgcctcggccggcgcctagcagccgacttagaactggtgcggaccaggggaatccgactgtttaattaaaacaaagcatcgcgaaggcccgcggcgggtgttgacgcgatgtgatttctgcccagtgctctgaatgtcaaagtgaagaaattcaatgaagcgcgggtaaacggcgggagtaactatgactctcttaag

SEQ ID NO: 1509 - DNA, 250 bp, Homo sapiens
gcggttccgcgcggcgcctcgcctcggccggcgcctagcagccgacttagaactggtgcggaccaggggaatccgactgtttaattaaaacaaagcatcgcgaaggcccgcggcgggtgttgacgcgatgtgatttctgcccagtgctctgaatgtcaaagtgaagaaattcaatgaagcgcgggtaaacggcgggagtaactatgactctcttaaggtagccaaatgcctcgtcatctaattagtgacg

SEQ ID NO: 1510 - DNA, 250 bp, Homo sapiens
tcccccccgccgggtccgcccccggggccgcggttccgcgcggcgcctcgcctcggccggcgcctagcagccgacttagaactggtgcggaccaggggaatccgactgtttaattaaaacaaagcatcgcgaaggcccgcggcgggtgttgacgcgatgtgatttctgcccagtgctctgaatgtcaaagtgaagaaattcaatgaagcgcgggtaaacggcgggagtaactatgactctcttaaggtag

SEQ ID NO: 1511 - DNA, 250 bp, Homo sapiens
cggcgcgctcgccggccgaggtgggatcccgaggcctctccagtccgccgagggcgcaccaccggcccgtctcgcccgccgcgccggggaggtggagcacgagcgcacgtgttaggacccgaaagatggtgaactatgcctgggcagggcgaagccagaggaaactctggtggaggtccgtagcggtcctgacgtgcaaatcggtcgtccgacctgggtataggggcgaaagactaatcgaaccatctag

SEQ ID NO: 1512 - DNA, 250 bp, Homo sapiens
gcattcgtattgcgccgctagaggtgaaattcttggaccggcgcaagacggaccagagcgaaagcatttgccaagaatgttttcattaatcaagaacgaaagtcggaggttcgaagacgatcagataccgtcgtagttccgaccataaacgatgccgaccggcgatgcggcggcgttattcccatgacccgccgggcagcttccgggaaaccaaagtctttgggttccggggggagtatggttgcaaagc

SEQ ID NO: 1513 - DNA, 250 bp, Homo sapiens
gtagccaaatgcctcgtcatctaattagtgacgcgcatgaatggatgaacgagattcccactgtccctacctactatccagcgaaaccacagccaagggaacgggcttggcggaatcagcggggaaagaagaccctgttgagcttgactctagtctggcacggtgaagagacatgagaggtgtagaataagtgggaggcccccggcgcccccccggtgtccccgcgaggggcccggggcggggtccgccg

SEQ ID NO: 1514 - DNA, 250 bp, Homo sapiens
cgcatgaatggatgaacgagattcccactgtccctacctactatccagcgaaaccacagccaagggaacgggcttggcggaatcagcggggaaagaagaccctgttgagcttgactctagtctggcacggtgaagagacatgagaggtgtagaataagtgggaggcccccggcgcccccccggtgtccccgcgaggggcccggggcggggtccgccggccctgcgggccgccggtgaaataccactactc

SEQ ID NO: 1515 - DNA, 250 bp, Homo sapiens
ccaaatgcctcgtcatctaattagtgacgcgcatgaatggatgaacgagattcccactgtccctacctactatccagcgaaaccacagccaagggaacgggcttggcggaatcagcggggaaagaagaccctgttgagcttgactctagtctggcacggtgaagagacatgagaggtgtagaataagtgggaggcccccggcgcccccccggtgtccccgcgaggggcccggggcggggtccgccggccc

SEQ ID NO: 1516 - DNA, 250 bp, Homo sapiens
tagctggttccctccgaagtttccctcaggatagctggcgctctcgcagacccgacgcacccccgccacgcagttttatccggtaaagcgaatgattagaggtcttggggccgaaacgatctcaacctattctcaaactttaaatgggtaagaagcccggctcgctggcgtggagccgggcgtggaatgcgagtgcctagtgggccacttttggtaagcagaactggcgctgcgggatgaaccgaacgcc

SEQ ID NO: 1517 - DNA, 250 bp, Homo sapiens
tgaaacttaaaggaattgacggaagggcaccaccaggagtggagcctgcggcttaatttgactcaacacgggaaacctcacccggcccggacacggacaggattgacagattgatagctctttctcgattccgtgggtggtggtgcatggccgttcttagttggtggagcgatttgtctggttaattccgataacgaacgagactctggcatgctaactagttacgcgacccccgagcggtcggcgtccc

SEQ ID NO: 1518 - DNA, 250 bp, Homo sapiens
tagcagccgacttagaactggtgcggaccaggggaatccgactgtttaattaaaacaaagcatcgcgaaggcccgcggcgggtgttgacgcgatgtgatttctgcccagtgctctgaatgtcaaagtgaagaaattcaatgaagcgcgggtaaacggcgggagtaactatgactctcttaaggtagccaaatgcctcgtcatctaattagtgacgcgcatgaatggatgaacgagattcccactgtccct

SEQ ID NO: 1519 - DNA, 250 bp, Homo sapiens
ccccccgccgggtccgcccccggggccgcggttccgcgcggcgcctcgcctcggccggcgcctagcagccgacttagaactggtgcggaccaggggaatccgactgtttaattaaaacaaagcatcgcgaaggcccgcggcgggtgttgacgcgatgtgatttctgcccagtgctctgaatgtcaaagtgaagaaattcaatgaagcgcgggtaaacggcgggagtaactatgactctcttaaggtagcc

SEQ ID NO: 1520 - DNA, 250 bp, Homo sapiens
gcgcaagacggaccagagcgaaagcatttgccaagaatgttttcattaatcaagaacgaaagtcggaggttcgaagacgatcagataccgtcgtagttccgaccataaacgatgccgaccggcgatgcggcggcgttattcccatgacccgccgggcagcttccgggaaaccaaagtctttgggttccggggggagtatggttgcaaagctgaaacttaaaggaattgacggaagggcaccaccaggagt

SEQ ID NO: 1521 - DNA, 250 bp, Homo sapiens
ggccgggcgcgacccgctccggggacagtgccaggtggggagtttgactggggcggtacacctgtcaaacggtaacgcaggtgtcctaaggcgagctcagggaggacagaaacctcccgtggagcagaagggcaaaagctcgcttgatcttgattttcagtacgaatacagaccgtgaaagcggggcctcacgatccttctgaccttttgggttttaagcaggaggtgtcagaaaagttaccacagggat

SEQ ID NO: 1522 - DNA, 19 bp, Homo sapiens
gtctacggccataccaccc

SEQ ID NO: 1523 - DNA, 38 bp, Homo sapiens
atcgcttctcggccttttggctaagatcaagtgtagta

SEQ ID NO: 1524 - DNA, 250 bp, Homo sapiens
acctactatccagcgaaaccacagccaagggaacgggcttggcggaatcagcggggaaagaagaccctgttgagcttgactctagtctggcacggtgaagagacatgagaggtgtagaataagtgggaggcccccggcgcccccccggtgtccccgcgaggggcccggggcggggtccgccggccctgcgggccgccggtgaaataccactactctgatcgttttttcactgacccggtgaggcgggggg

SEQ ID NO: 1525 - DNA, 250 bp, Homo sapiens
aaatgcctcgtcatctaattagtgacgcgcatgaatggatgaacgagattcccactgtccctacctactatccagcgaaaccacagccaagggaacgggcttggcggaatcagcggggaaagaagaccctgttgagcttgactctagtctggcacggtgaagagacatgagaggtgtagaataagtgggaggcccccggcgcccccccggtgtccccgcgaggggcccggggcggggtccgccggccctg

SEQ ID NO: 1526 - DNA, 250 bp, Homo sapiens
ggagcctgcggcttaatttgactcaacacgggaaacctcacccggcccggacacggacaggattgacagattgatagctctttctcgattccgtgggtggtggtgcatggccgttcttagttggtggagcgatttgtctggttaattccgataacgaacgagactctggcatgctaactagttacgcgacccccgagcggtcggcgtcccccaacttcttagagggacaagtggcgttcagccacccgag

SEQ ID NO: 1527 - DNA, 250 bp, Homo sapiens
aactggcttgtggcggccaagcgttcatagcgacgtcgctttttgatccttcgatgtcggctcttcctatcattgtgaagcagaattcaccaagcgttggattgttcacccactaatagggaacgtgagctgggtttagaccgtcgtgagacaggttagttttaccctactgatgatgtgttgttgccatggtaatcctgctcagtacgagaggaaccgcaggttcagacatttggtgtatgtgcttggc

SEQ ID NO: 1528 - DNA, 102 bp, Homo sapiens
tgaacgcgcccgatctcgtctgatctcggaagctaagcagggtcgggcctggttagtacttggatgggagaccgcctgggaataccgggtgctgtaggcttt

SEQ ID NO: 1529 - DNA, 150 bp, Homo sapiens
tctgttcttatcagtttaatatctgatacgtcctctatccgaggacaatatattaaatggatttttggagcagggagatggaataggagcttgctccgtccactccacgcatcgacctggtattgcagtacctccaggaacggtgcaccc

SEQ ID NO: 1530 - protein, 25 aa, Artificial Sequence
  source: /note="Description of Artificial Sequence: Synthetic peptide"
KRASSQALGTIPKRRSSSRFIKRKK

SEQ ID NO: 1531 - protein, 7 aa, Artificial Sequence
  source: /note="Description of Artificial Sequence: Synthetic peptide"
RKKRKKK

SEQ ID NO: 1532 - DNA, 12 bp, Artificial Sequence
  source: /note="Description of Artificial Sequence: Synthetic oligonucleotide"
  misc_feature (1)..(12): /note="This sequence may encompass 2-4 'tca' repeating units"
tcatcatcatca

SEQ ID NO: 1533 - DNA, 12 bp, Artificial Sequence
  source: /note="Description of Artificial Sequence: Synthetic oligonucleotide"
  misc_feature (1)..(12): /note="This sequence may encompass 2-4 'tga' repeating units"
tgatgatgatga

SEQ ID NO: 1534 - protein, 5 aa, Artificial Sequence
  source: /note="Description of Artificial Sequence: Synthetic peptide"
EAAAK

SEQ ID NO: 1535 - protein, 5 aa, Artificial Sequence
  source: /note="Description of Artificial Sequence: Synthetic peptide"
GGGGS

SEQ ID NO: 1536 - protein, 4 aa, Artificial Sequence
  source: /note="Description of Artificial Sequence: Synthetic peptide"
  source: /note="See specification as filed for detailed description of substitutions and preferred embodiments"
GGGS

SEQ ID NO: 1537 - protein, 5 aa, Unknown
  source: /note="Description of Unknown: Thrombin-sensitive sequence"
CPRSC

SEQ ID NO: 1538 - DNA, 100 bp, Artificial Sequence
  source: /note="Description of Artificial Sequence: Synthetic polynucleotide"
tagccaaatgcctcgtcatctaattagtgacgcgcatgaatggatgaacgagattcccactgtccctacctactatccagcgaaaccacagccaagggaa

SEQ ID NO: 1539 - DNA, 4673 bp, Taeniopygia guttata
gtctagttacaactgggcatcgctgcagagatcgcacctcctcgtggtcccgctggtagcccttcgaagggtgactaagtcgatctctgccccaggtacggagccgttgggactcaccagtccaacgtaactcctgcctaaattcggtgaaacaaattcctcggtaaaaagccccatggcttcttgcccgaaacctggccccccggtttcagcaggggcaatgagtttggaaagtggactgaccacccactccgttctcgccatcgaacgtggtcccaattcgttggcaaattccggatcagactttgggggggggggtctggggctaccgttacgcctattgagggtatcggtcggcactcagacctcccgctccgactgggtagacctggtgtcctggagccacccaggacccacgtctaagtcccagcaggttgacctggtgtctttatttcctaaacaccgggttgacctgttatccaaaaacgaccaggtagacctggtggctcaatttttaccatctaaatttccccccaatttggcagaaaatgatttggctttgctggtgaacttagagttctacagatcggatttgcatgtgtatgagtgtgttcattttgctgcacattgggagggattaagtggtttgcctgaggtgtatgaacaacttgcaccacaaccgtgtgtgggagaaactttacattctagcctcccacgagacagtgaactgtttgtgcctgaagaggggagcagcgagaaggagagcgaggacgcgccaaaaacatctcctccgacgcctgggaaacatggtttggaacagactggggaggaaaaagtgatggtgactgttcctgacaaaaatccaccttgtccttgctgtggtacccgggtaaactctgtgttgaatctgattgaacatctgaaagtgtcacacgggaaaaggggggtttgttttcggtgtgcaaaatgtggaaaggaaaatagtaactatcacagtgttgtttgtcattttccaaaatgcaggggtccagagacggagaaagccccagctggggagtggatttgtgaggtatgcaacagagattttacaaccaaaattggcctgggacaacacaagagattggcacacccagcagtgagaaatcaggaaaggatcgttgcttcccaaccgaaagaaacatcaaatagaggtgctcacaaaaggtgctggacaaaggaggaggaagaattactaataagactggaggctcagttcgagggaaacaaaaatattaataagcttattgcagaacacataaccaccaaaacagctaagcagatcagtgacaaaaggcgattgctgtccagaaagccagcagaggagccacgtgaggagcctggaacgtgtcatcacaccaggagagcagctgcgagcctgagaacggagcctgagatgagtcatcacgcccaggcagaggacagagataatggacctgggagacgccctctgccaggcagggcagctgccggagggagaacaatggacgagataagacgccaccctgataagggcaacggacagcagagacccaccaagcaaaaatcagaagaacagctgcaggcttactataaaaagacactagaggaacgactttcagctggggcacttaacaccttcccccgagcattcaagcaggtaatggaaggccgggatataaagctagtaatcaatcagacagcgcaggactgcttcggatgcctggaatccataagccaaataagaacggcaacccgagataaaaaggacacggtgacccgggagaaacacccaaagaaaccttttcagaagtggatgaaggacagagcaatcaaaaaaggtaattatcttcggttccagcgtttattttatcttgatagagggaaactggctaaaatcattttagatgatattgaatgcttgtcttgtgacataccactcagtgaaatttattcggtttttaaaacaagatgggaaacaactggtagctttaaaagccttggggactttaaaacttacgggaaggctgacaacactgccttcagagaattaattacggctaaagaaattgagaaaaatgtgcaggaaatgagcaaaggctcggctcccggtccagacgggattactcttggggacgtcgtaaagatggatcccgagttttcccggaccatggagattttcaatttatggttaacaactggtaaaatcccggacatggtgagggggtgcagaaccgttttgattccaaaatcatcaaagccggatcgtttgaaagacattaataactggagacctatcacgatcggttccatcttgctgagactgttctccaggattgtaacagctaggctgagcaaagcgtgccccctgaacccaaggcaaagaggctttatcagagcggcgggatgctctgaaaacttaaaactcctgcaaactataatttggtcggccaaaagagaacacagaccactgggtgttgtattcgtggacatcgccaaggcttttgacaccgtaagccaccagcacatcattcatgctttgcagcaaagagaggtggatccccacatcgtcggtctggtgagcaatatgtacgagaacatcagtacgtatatcaccacaaagaggaacacacacacagacaaaatccagatccgggttggagtaaagcagggtgacccgatgtcgccccttttatttaacctggcaatggaccctctattatgcaagctggaagagagtggcaaaggataccaccgaggacagagcagcatcacagcgatggcatttgcagacgatctggttttgctgagcgactcctgggaaaatatgaatacaaatattagcatactggagaccttctgcaatctgaccggtctcaaaacacaggggcaaaagtgccacggcttttacatcaagccgacaaaggactcttacaccatcaatgactgcgctgcctggactatcaacggcacacccctgaacatgatcgaccccggcgaatctgagaaatacctcggcctgcagtttgacccgtggattggaatagcaaggtccggtctctccacaaaactagatttttggcttcagcggatcgatcaagcaccacttaaacctctgcagaaaactgatattctcaaaacatacaccatccctcggctgatctacatagctgaccactcagaagtgaaaactgcactactcgaaacccttgaccagaagatccggacagcggtcaaggaatggcttcacctacctccgtgcacctgcgatgccatcctgtactcgagcacgagagacggcggtttgggcatcaccaaattggcaggactgatccccagcgtgcaggcccgtagactgcatcggatcgcacagtcatctgacgatacgatgaaatgcttcatggaaaaagagaaaatggaacagctgcataagaaattgtggattcaagctggaggggacagagagaacataccctcgatttgggaagcaccaccgtcgagtgaaccaccaaacaacgtgagcacaaattcggaatgggaagcaccgacccagaaagataaatttccaaagccttgcaattggaggaaaaacgaattcaaaaaatggaccaaattggcatcccaaggccgcggaattgtaaattttgaaagagacaaaattagtaaccattggatccaatactacagacgcatacctcacaggaaactcctcactgcactacaactcagggccaacgtttaccccacgagagaatttctagccaggggtagacaagaccaatacatcaaggcgtgtaggcactgcgatgcggacattgaatcctgcgcccacatcatcggcaactgcccagtgacacaggacgcccgaatcaagaggcacaattacatctgcgaactgcttctcgaggaggcgaagaagaaggactgggtagtgttcaaggaaccgcacataagggattccaacaaggaactgtacaaacctgacctgatatttgtgaaggatgcccgtgcacttgtcgtggatgtgacagtacggtatgaagcagccaaatcatcgctggaggaagccgctgcagagaaagtgagaaagtacaaacacctggaaacggaagtaagacatctcacgaatgcaaaggacgttacttttgtgggctttcccctaggagcgcgggggaaatggcaccaagataactttaaacttttgactgagcttggcctctccaaatcgaggcaagtgaaaatggcagagactttttccacagtagcgctcttttcatctgtggacattgtacatatgtttgccagtagggccagaaaatctatggttatgtaattcaggttatttagatgcttagtttttgtacctttcttgttttgtttaggattttgatagtgttagtatttttatatttttgtacgattgcataatgttcttttttatacagttctgttttaataaaatagacgatagctagagacgttagggcagccacaagccagttaggtagcggatagtaggtaggaacagacttttactatttcataacgcgtcaattaccacctgatttggaccaattcacgggatttgtccaaggtggacgggccacctttacttaacccggaaaaggaacatatataatttatgtgtgttcgataaa

SEQ ID NO: 1540 - DNA, 4478 bp, Geospiza fortis
agacttaagtgagtttggttacaactgggcatagctgcagagaccgcgcctcctcgcggccccgctggtaagcccttaacagggtgactaagtcggtctctgccccagtccgggagtcgatgggactcaccagcccaacgattccttccaaaatttcggtgaaacaaatttctcggtgcaagtcgcaaggcttgtcacccgaaacctagccccccggtcggtcaggggcaacgggttcggaagtgggatggccacccaccccgttcccgcagacgaatccggccatgaatctgatccattccttgtagggaggagctgcggacaaccggcacgccttactaggcaatcggttggcacccagacctcccgagatgatattttaccatctaaaaccaccaaattgacagagaatgaattggacttgctggtgaacttttctttagaattgtataggtcagatctgcagggatttgtgcaggaggggattcatttttctgtgaatagggaggtgttagaggggtttcctgaggtgtatgaacaacctgcaccacaaccggcagtaggggacgatttaaacaccagtctcccaccggacaataatatatgcgtacttgagaagggtagcagtgaagcagtggaggatggcacaccggaggtagcgcaccccgtgcctgaaacccagggcaaagagtcaccgaataacatcgtgatggtaactcttcccaacaaaaatccaccatgtccttgctgtagggtcagactgcattcagtactggctctgattgaacatcttaaggggtcgcatgggaagaagagggcatgctttaggtgtgtcaagtgtgggagggagaactttaactatcatagtactgtttgtcacatcgcaaaatgcaagggaccaaaagttgagaaggccccagtgggagagtggatctgtgaggtatgtggtagggactttacaaccaaaatcggcctgggacaacataaaagattggcacatcccttggttagaaaccaagaaaggatcgatgcttcccaaccgaaggagacatcaaacagaggagcccacaagagatgttggacaaaagaggaggaggagatgctgataaagttggaggtacagttcgagggacacagaaacatcaataagcttatcgcggaacacttaacaactaaaacatccaaacagattagtgataaaaggagactattacccagaaaacaattaacagatctaagtaagggagtggctggacagaaggtgctggacccaggactgagtcatcaaccccagctgggggtagttgacaatggacttggtgggggtcatctgccaggggggccagctgctgaaggaagaacaatagagccattaggacaccaccttgataaggataacggtcaccgggaaatcgctgaccagcacaaggcagggaggctgcaggcccattaccgaaagaagataaggaagcgcctttcagaagggatgattagcaacttccccgaagtatttgaacaactactggactgccaggaagcacaaccattgatcaatcaagcagcgcaggattgctttggatgcctggattcagcaagccagataaggaaggcgctccgaaaacagaacacacagaaagaccagggggatcaacccaaaagaccagctcagaagtggatgaaaaaaagagcagttaagaggggtcacttcctccgctttcagaaattatttcatcttgacagggggaaattggcaaagattattttggacgacgtagagtgtttgtcctgtgatataccacccagtgaaatttattcggtattcaaagcccgatgggaaacacctggacagtttgctggccttggggatttcgaaattaataggaaggcgaacaataaagccttcagggacttaattacggccaaagaaattctcaaaaatgtgcgggagatgaccaagggctcggccccaggtccagatgggatcgcgcttggggacatcaggaagatggaccctgagtacacccggaccgccgaactcttcaacttatggttaacatctggtgagatcccggacatggtgagggggtgcagaactgtgttaatccccaaatcgtcaaaaccggaacgcctgaaggacatcaataactggagacccatcacgattggatccatcttgctgagacttttctccaggatcataacagcgaggttaacaaaggcgtgccccctcaaccctaggcaaagaagcttcatcagtgcggcaggatgctccgagaacttgaagctcctgcaaaccataattcggactgctaaaaatgaacacagaccactgggtgttgtattcgtggacatcgccaaggcctttgacaccgtgagccaccaacacatcatacatgtattgcaaaggaggagagtggacccccacatcattggattggtgaaaaatatgtacaaagacatcagtacggttatcaccacaaagaagaacacatacacggacaaaatccagatccaggttggagtgaagcaaggtgatccgctttcgccccttctattcaacctggcgatggaccccctgttgtgcaagctggaagaacacggcaaaggattccaccgaggacagagcaagataacagcgatggcattcgctgatgacctggtcctgttgagcgattcctgggaagacatgaatgcgaacatcaagatactggagaccttctgcgacctcaccggtctcaaaacacagggtcaaaagtgccacggcttctacatcaagcctacaaaggactcttacaccgtcaacaactgcgctgcgtggaccatcaatggcacacccctgaacatgatcaaccccggggaatcagagaaatacctcggcctgcagtttgacccctgggtgggaattgcaaagaccagcctccccgaaaaactggacttctggctcgaacgcattgatcgagctccactcaaaccatttcagaaactggacattcttaagacatacaccatacctcgactgacctacgtagctgaccactcagagatgaaagcgggggcccttgaagcccttgaccggacaattcgatcggcggtcaaggactggctgcacctaccttcgagcacctgtgatgccatcttgtacacgagcatgaaggacggtggtttgggagtgaccaaattggtgggactgattccgagtgtacaagcccggaggctgcacaggattgcgcagtcaccggaggagacgatgaaagacttcctggaaaaggcccagatggagaagatgtacgagaaattgtgggtccaagctggagggaaaagaaagaggatgccgtcaatttgggaagcgctcccggaggttgtaccatccatagacacagccacaacttcggagtgggaagcaccgaaccctaaaagtaagtaccctagaccttgtaattggcgcagaaaagaatttaaaaagtggactaaattaatagcccagggctggggaattaggtgttttaagggggacaaaattagtaacaattggattcgacattatagatacatacctcacaggaaacttctcactgccatacagctccgggccagtgtgtaccccacaagggaatttctcgcgcgggggagggaagataactgtgttaagtcttgtaggcactgtgaggcggcagaggagtcctgtgcccacatcatcggcatgtgtccagtcgtgagggatgcccgaatcaagaggcacaatcgcatttgcgagaggctgatggaggaggcggggaagagggactggacggtgtttcaggagccgcacataagggacgtcaccaaggaactgtacaaaccggacttgatattcgtgaaagaaggccttgcacttgttgtggatgttacaatacggttcgagtcaaccaagacaacgttggaggaggctgctgcagagaaggtgaacaagtacaaacatctggagaccgaagtacggaacctcaccaacgctaaggacgttatctttatggggtttccccttggagcgcggggacaatggtacaataagaactttgaacttttggacactcttggcctccccagatcgaggcaggacattattgcaaagactttatccacggacgcgctcatttcatctgtggacattatacatatgtttgccagtagaggcagaagacagcatgcttagggtagataatctttgtatagtggggggggatctcatgtaccgggtttcttttatttgattttcaataaaacagacggtagctaggttcgcaaggcagccacaagccaaagataggtagggtgctcatagtgagtagggacagtgccttttgattcacaacgcgtcaataccatctgacacggatacccttaccggacttgtcatgatctcccagacttgtccaaggtggacgggccacctttacttaacccggaaaaggaacatatattaattatatgtgttcggaaaa

SEQ ID NO: 1541 - DNA, 4542 bp, Zonotrichia albicollis
cgacttgagaaggtctggttacaactgggcatagctgcagagatcgcgcctcctcgtggccccgctggtaagcccttaacagggtgactaagtcgatctctgccccagtccaggagccgctgggtttcaccagcccagcgattccttccaaattcggtgaaacaaattcctcggtaaaagccgcgtggcttattgcctgaaacctggccccccggtttcagacaggggcaaagagttcggaagtggactgaccacccaccccgaacccgagagcgaatctggtcatgacccaactgtcccaaatcctggtccgtctcttggagcgggggaaggtgcacagccactacccttactcagggtatcggtgggcacccaaacctgtgaagaggactttataacatctagaccaaccaaattacccggaattgaatcagaattaggcccgctggtgaagttttctttagaggtttacaggtcagatcttaagggggatgtgcaatttgaggggattcattttccagataattggggggtactggaggggtttcctgaggtgtacgaacaactggcaccacagccaaacgggggagacgagttaaatcatagtctcccaggggacagggagggggatgtacttgagaaggatagcagcgaaaaggagaaggaggctgcaccagaggcattgccctcagtgcaaagggcccgcagtgaacagttgccagataacatcgtaaaggtgactgttcccgacaaaaatccaccatgtccctgctgtggtgtccgcttaaactcagtgttagctctgattgaacatctgaagggctcacacgggaggaggagggtgtgctttaggtgtgccaaatgtgggagggagaattttaaccaccatagtactgtttgtcattacgcaaagtgcaaaggtccacagattgaaaggccaccagtgggagagtggatctgtgaggtatgcggaagggacttcacgaccaaaattggcctgggacaacacaaaagacatatgcatgcaatggtgagaaaccaggaaaggatcgatgcttcccaaccgaaagagacatcaaatcgaggagcccacaagaggtgctggacgaaggaggaggaagaactgctcatgaagttggaggtacagtttgagaatcacaaaaacatcaataagcttatcgcagagcaattaacaactaaaacagctaaacaaattagtgataaaaggagaatgctgctcaaaaaaggtagggggacaactggtaatttggaaacagagcctgggatgagtcatcaatcgcaggcaaaagttaaggacaatggactgggtggggaccatctgccgggaggaccagttgtcgataagggaacaatagggaagccaggacaacatcttgacacagataacagccatcaaataactgctggcaagaagaaagggggagggctgcaggctcgttatagaaggagaataatgaaacgattagcggccgggacaattaacatcttccccaaagtgtttaaagaactgattaacgaccaagaggcgagaccgctaatcaatcaaacaacagaagactgctttggcctcttggactctgcatgccaaattagaacggcactccgggagaagggcaaatctcaggaggaacgaccaagaaaacagtatcagaagtggatgaagaagagagcgattaaaaggggggactatctccgcttccagcgattattccatctagacagggggaaactggcgagaattatcttggacaacactgagagcttgtcttgcgatatatcacccagtgaaatttattcggtattcaaggccagatgggaaacacctggacacttcaacggccttggggactttgaaattaaagggaaggccaacaacaaagccttcagggacttcatcacggctaaagaaattgaaaagaacgtgcgggaaatgagtaagggttcggcgccaggtccagatgggatcgcccttggggacatcaagaagatggatcccgggtattcccggaccgccgagctattcaacttgtggctgacagctggtgacatcccggacatggtgagggggtgcaggactgttttgatcccgaaatcgacgacaccggagcgcctaaaggacatcaacaactggagacccatcacgattggttccatcttgctaaggctgttctccaggatcataacggcgaggatgactaaggcgtgccccctcaacccgagacagagaggcttcatcagtgcgccgggatgctctgagaacctgaaactcctgcaatctataattcggactgccaaaaatgagcacaagccgctgggtgttattttcgtggacattgctaaggcttttgacaccgtgagccaccaacacatcatacacgttttacagcaacggagggttgacccccacattgttggactggtgaacaatatgtacaaggacatcagtacgtatgtcaccacaaagaagaacacacacacggacaaaatccagatccgggttggagtgaagcagggtgacccactatcaccccttctattcaacttggcaatggaccccctgttgtgtaagctggaagaaagtggcaaaggattccatcgaggacagagctcaataaccgcgatggcgttcgccgacgatctggtcttgttaagcgactcctgggagaacatgaaagagaacatcaaaatactggagaccttttgcaatctcaccggtctcaaaacacagggtcagaagtgccacggcttttacatcaagcctacaaaggactcttacaccatcaacaactgccctgcatggaccatcaacggcacacccctgaacatgatcaaccccggggagtcagagaaatacctcggcctgcagatcgacccatggactggagtagcaaaatacgatctctccacaaaattgaaaatatggctcgaaagcattgaccgagctccacttaaacctctgcaaaaattagacatcctcaaaacatacaccattcctcgactgacctacctggctgaccattcagagatgaaagcaggggctctggaagcactcgaccagcagattcgaacagcggtcaaagactggctgcacctgccctcgtgcacctgtgatgccatcttgtacgtgagcacgagggacggcggtttgggtgttaccaagttggcgggactgattccaagtgtgcaagcccggaggctgcatcgcattgcgcagtcgccggacgagacgatgaaggacttcctagagaaggcgcagatggagaagatgtatgagaagttatgggttcaagctggaggcaaaaagaaggggatgccgtcaatttgggaggccctaccgatgactgtaccacccactaatacaggtaatctttcggagtgggaagcaccgaaccccaaaagtaagtacccaaaaccttgtgattggagaaggaaagagcttaaaaagtggacaaaattggagtcccaaggtcgtggagtcaaaaattttaggaatgatacaattagtaacgattggatccaatattatagacgcatacctcacaggaaactcctcactgccatacaactcagggccaatgtataccccacaagggaatttctcgcgcgggggaggggtgataactatgttaagttttgtaggcactgtgaagcggaccttgaaacctgtggccatatcatcggcttttgcccagtaacgaaggacgcccgaatcaagaggcacaatcgcatatgcgacaggctttgcgaggaggcagctaagagggaatgggtggtcttcaaggagccgcacttgagggatgccaccacggaactgtttaaaccggatgtgatattcgtgaaagaggaccgtgcactggttgtggatgtgacagtacgatatgaatcagccaagacaacgctggaggcagctgctatggagaaagtggacaagtacaaacatctggaggcagaagtgaaggaactcaccaacgcaaaggacgttgtttttatggggttcccccttggagcgcgagggaaattctacaaagggaactttaacttgctagagactcttggcctcccaaaaacgaggcaattgagtgtggcaaagactctatccacgtacgcgctcatgtcatctgtggacattgtgcatatgtttgccagtagatctaggaaaccaaatgtctaggtagtcacattgcactttctgtaacttgcactgggtgtgggatgtgggcctggggtgtgggttatggggtatatatgtgggatattctggtgggaatgtccattcactgtatgcctatctttttaataaaaagacggtagctaggttcgcgaagcagccacaagccaatagccagttaggtagctcatagtgggtaggtgacaggaacctttgactcagaacgcgtccattaacatctagaacggaccaaacttcggacatgcaccgattaaccggatttgtccaaggtggacgggccacctttacttaacccggaaagggaacatatatagttatatgtgttcgtaata

SEQ ID NO: 1542 - DNA, 5183 bp, Danio rerio
aatcccccctacccaatccccccgtcgtgacctccaggccaggaatcacgagcgtacgacagtggccatccggcaatgacaatagcgtgactaacgacaatgagtcagatccatgacccttggagtgggttaacctccgcctctttaaaaacatggaaagtacagcaaaaggaaagtcatactggatggcccgtcgcccagtagaaggtgccacggagggatctttgggtcgggtccctttcgtaacgcgagatcctaagcgcaaaccagaggctaaacgaacacttacgcatggcttaggactacgagaatgctcggttgtcttgacacgcctcatcgaggggcgtcgaggtcgcgatcacacaccatcaggatggaacgcacagcgcggcatgccaaacgacgaaagctcggtcgaggagcccaatgggccgataccatctaaccccataccaacgggcacccaagccctgcctgaacctatggcggacggggagcagggggagcacccgggagtggtggtgaccctgccgctcagggacttaaactgccccctatgtggcgggtcggcgagcaccgcggtgaaagtgcaaagacacttggcatttcgccacggaacagtgccggttagattcagctgtgaatcatgtggaaaaacttctccgggttgccattccgtcctctgtcacattccgaaatgtcgcggaccgacaggcgagccgcctgagaaagtggttaagtgcgagggatgcagtaggacgtttggcacaaggagagcgtgtagtatacatgagatgcacgttcactcagaaatccgcaataggaaaagaattgctcaagacaggcaagaaaaagggacctcgacagatggagaggggagagctggagtcgaaagggctgacgctggggaaggtccctctggggaagggatcccccctaaacgtcccagacgtgcgagaacgcccagagaaccgtctgagccccccgcgaatccgccgattctctcgccacaacccgatctgcccccaggaggcctccgggacctactccgggaggtggccagtgggtgggtaagggcagcgagagacggaggtacggtgattgacagcgtgctcgcagcatggttggatggcaacgatcggctccctgagctggttgacgcggcgacgcaaaggacactgcagggcttacctgcagggaggttggcccgaagacccgcaacttttgttgcgcctaaccggaggagaggcaggtgggggcgccggctcaaactgctcgctaagcgccgcgcctaccacgattgccaaattcggttccgaaaagacccagcccgcctagccgcgaacatcctagacggcaaaagcgaaacaagttgcccaatcaatgagcaagcgattcatgagcactttcgaaacaaatgggcaaatccaagtccatttggtgggctgggacgatttgggacggaaaacagggccaacaacgcccacctcctcgggccaatctccaaaagcgaggtccaaactagcctccgaaatgcatcgaacgcctccacaccaggcccagacggcgttgggaaaagggacatttccaactgggatcctgagtgtgagaccctcactcagctgtttaacatgtggtggttcacaggtgtcatcccctctcgcttgaagaaaagtcgtacggtgcttctgcccaagtcctcagacccaggagcggagatggagatcggcaactggagaccaatcaccatcgggtcgatggtcttgcggcttttcacaagggtgatcaatacgagattaacggaagcctgtccgttgcacccaagacagagagggtttcgacgaagccccgggtgttcggagaacctggaagtactcgaatgtctcctccgacactccaaagaaaagcgcagccaactggcagtggtattcgtcgattttgcacaagcgtttgacaccgtctctcatgaacacatgctgtcagtccttgagcagatgaacgtggatccccacatggtaaatctgatccgggagatttacacaaacagctgcacaagtgtcgagctaggccggaaagagggaccagacatcccagtgagggttggtgttaagcaaggggatcctctgtccccgctgcttttcaacctggctttggatcctctcatccaaagtctcgaacgcacaggcaaagggtgtgaggccgaaggtcacaaagtgacagctttagcgttcgcggatgacctggcactggttgcgggctcgtgggagggaatggcacacaaccttgcgcttgtagacgaattctgcctaaccaccggcctcacagtccaacccaaaaagtgccacagtttcatggtcaggccctgcagaggtgccttcacagtgaacgactgccccccatgggttctggggggcaaggccctgcagctaacaaacatcgaaaactccatcaaatatctgggagtaaaagtcaatccttgggcggggattgaaaagcctgaccttacagtggcactagaccgatggtgcaagcgcattgggaagtcactgctcaaaccctcacagaaggtatacattctcaatcagtttgccatcccgcgactcttctacctggctgatcacggtggggccggcgacgtcatgctccagaacctggatgggacaatcaggaaggcggtgaagaaatggctgcatcttccaccgtcaacctgcaacgggctgttgtatgccaggaactgtaatggtggcctcggtatatgcaagctcactcggcacatcccatcaatgcaggcgagacgaatgttccgcttggccaactcatcggacccgttgatgaaggccatgatgcgcggctcccgagtcgaacagaaattcaaaaaggcctggatgcgggccgggggagaggagagtgcgctcccacgggtgttcggggcgaatcagtaccaggaaggggaggaggtcgctaacgatctggtacctcgctgcccaatgccgagcgattggagactggaagaattccaacactggatgggcctgccgatccagggtgtgggtatagccggcttcttcagaaacagggtggctaacggatggctcaggaagccggcagggttcaaagagcggcactacatcgccgctctacaactgcgagcatgtgtataccccaccctcgaattccagcaaaggggcaggagcaaagcgggtgcggcctgcaggcggtgctcatcccggttggaatccagctctcacatcctcggcaaatgtccggcggtgcagggagccagaatcaggcgtcataacaaaatatgcgacctcctgaaggccgaagccgaaacccggggttgggaggtacgccgggaatgggccttcagaactccggctggggaactgagaaggctcgacctggtactcatcctcggggatgaggcattggtcattgacgtcacagtaaggtacgagttcgctccggataccctccagaatgccggaaaggacaaggtcagctactacggcccgcacaaagaagcgatcgctcgggagctgggcgtaagaagggtcgacatacatgggtttccgttgggtgcacgcggactttggctcgccagcaactccaaagtgctggaactgatgggattgagcagggaaagagtgaaggtcttctccagactcttgagtcggagagtgctcctgtactctatcgacatcatgaggacattttacgcaaccctgcaatgaaaatcccagcgggatacagcaagaaggtatcggatctaataaggttgagcgaggagagggtggagatcctttggggggggtcgggctaagttcccctctcgggtcctcccacggtgacgctctacccctccctcctcgctcgtagaacccaacggtgaacacggttggcaggatgaagtgacgtgaggggtaagacatgcgtacgtgagcgcgcatttttgctgttctctggactgggtttcgtccccctcacaaccatcacttacactataggggcacagcggctcctacctccctccctatgacccccccttcccataccgatccatggctgttctagtctggaccgagggtcggacggggcatttgaaggtagctggaatcctccgctgctgcgagcctgaggtcgatggttagaggtgaaatacttgggaggagacacagcctccggagagcccctcccgggtggtcatcatggcaaccgggtgaaaccttacggtttcacttacgaaacagcaccataacagcgccgtaatagcgcaccggtgtgactactgtccagtgctgatattctcatctggagaatacaacacgggtaatggcagagtattcaaaacccaaatgtttacgatcgaccaacggagtcgttcccttgcatctaggccggacccgaaactgccgtaattgcccgtccccaaggtagcctcttagaaaaccgaagcccggtcggggcggtggttgcggcggcgctgcgggggcctgctgctcgggcggcgtcggtgtgccgcggtggttgcggtggtgcggcggggatctcggtccttgcggtgccgctgtgccgccgcggtcgcgtcggtggcgctggggtggtggcccgagtggcgtcggcgtgccactgcccatagtcgcccgcgggggcgaccgatctggaggggcgagggggctcgcgggactttaacgagaaacggaacgcaacttctcgcatcgctcccgggactttcccccctcgttcagccgagggatgccaaaaggcatgaaaggtaagtaccataccggtccgcaaaactctcttctgactcggttctctgttggttttctagagtaacaacgaggtggaggagagggacatggcagggactcccattcgtgccagcgggtggggacagatcgaaggaacggttcgagggcgtaacagacgagagggaatccggtcacacattgatgccatgcctaaataggcgaggtttgtatttctactttgtgggttcagtatagtcggagcatatggtcggttgtcccgttgttttcacggcgggcaagcgactatcatgataaagtagaatgggagacgggctccctgacaaacccggaaaggcgcccccccgtggttcgtagcagctgacggatcacgctcgaagaaaaatgagtgagaggggacgccgcaaccac

SEQ ID NO: 1543 - DNA, 6020 bp, Gasterosteus aculeatus
catattggggtctcaggaggagacacagggtctgttgcggctccggtaaacggtaccggagtcggttaagcatcgtttgggcccgcctccacgtggtggtccgcggtaacaccaatagggtggctaagaggcccagtaatttccccgaattgtcttcccccccgcgcgggggggacccccctttagtgtcggagcggtcgcgcctccgcgtttggggtgtcgcaggcgtgagccttcgtccccttaagttcagacggtcccggcttcttgccgggccaacccccggtgcagcgttctcccatgttggatcggcacccagccccgggtgccatgcgagttcagacattttgtttatgtatcgtctgcgtggttgacttgctaagctcatttcctcctctcactgcgtccccccaggtgctgatcggttgaagaggattcgtcgttgacctcggcggtgaatttgggattgtattatacaggtaggtatagagggcgtgcggatgttgcgtggcggtgttggtactcccccggctgggggagcgggtgcggtggggccaggcatggcctcgccgggtggttgcagtgtccggttcagtcccggagggaggcgactgcttggccacaggactggagggttgagtccctccgtgtcctggaggctcaagcgactgtctgtctctctgaggcgctggagcgggcctgggctgctaggtgcggatggtgcggggggaggcgctgcggtggcctcccccaggggtacgcaggtcctgggaagtggggccgggcgtcggtggcttgggcacgggtcgcgagggtcttctccttctgcggcccgggggctaaggcggctgacggtacggttgaagcgactcagcggtggcctgttgtcccctaaggcgtgtcgggatgcggaagaaggaagctccagcagcccagggttccggaatccaaaaggtctcgggggaagggggttgacgcctctcggatcccgtagattttgtcggctgaccgtctccctgaatcgctggaggggcagtctggtgaagttgaacgctagtagcagggcctccggccggaggacccctgtgaaacccgcttgtgactctagagccggacggggctcggagcatgcggagggaggtggagtgagcgctgcacctatggtgttgcgcagtcggcgtaagctcaccttctctgtggatggcgactctaactccggggatagggcccggagcgggtccgtctctgcagcccgtcctggccacttgttggtggatggtgagagtgcgtcctcaagatctggccccgcgggggatgccaggttggcggggccttctacgcggagtaggaggaagggttgccttcccccggtcgactttgaaaacccgaagaagcgcacacggttgatggctaagatgacgaatggtaatcctacctcgcacgtcccttgccctgccccgtgctcaaatgggcatgaaggaggtgggcgagttgcggtgatcgaggggcggctgccggagttaagcggtagtaggatctctggaatacagccagccctgcctgttgaaaccagctttgtcggccaatcgactggccggggcgcggacggcgatgcgaatgcgaatagtagcccgccttctcctaatctgggcggctcggttgggatggtgcctgccgtgcgtgatggtaccccgccgcttgggcgtccaggagaggatcactcgcgggagtgtgcagggggaaatactcccctctggatgctggaggacagtttccggtgtgactactgtcctagggaattcggcacaagagcggggcgctcgttgcacatgcgcagggctcacctggccgagtacgacggggcaggtttctgttggggtgaacgtctcagtgaattcgccgctacgcgcctctggtcgacggaggaaaccaaaaagctggccgtgttttgtgagaggggtgtgccctcaccgtcggaatgcagagccattgcagcctctctgggcgcaggaaaaacacatcatcaggttagatcgaagtgtcgactggtgttcgaggccattcggcggcgtgaattgcttgaggtggctgctgccacggagcgtttggagaaaagcgctaggcggaagcagcccgccgtaccaccggcacccgtacacggagtgagaggggtcctgcggggcctactagggaagcgggtgccgagagagggtggtaccacaggcagcacctcagcaaggatcgtcaggagagacgactgccgtcagggggcagttgcgtcggcttctctcaatctgatcagaaggctgggtcgaaaggcaacgggccgctccggcaggagacgggtccttggacgcccacccaggatggatgtaaggcgtagcgtgaggatgaggaggatgcgcaggttcctctatcggttggcccggctgggctgggccaagttggctatgtttgtcctggacggacagatgggggcgagctgccccgttccactcgtcgaagtgtcggcggtcttccgggagaggtggagcatagtcagagccttcctgggtctgggtcagttcgggggcttcgggactgccgacaacgcaggatttgggaagctgatcgatccggctgaagtcagggcccatctccagtccatcaagaaccggtcttccccgggcccggatggcatcaccaaggtggcgctgtccaaatgggaccccgaagggattaaattggcgcacatgtactcaacatggttggtatcggcaggcatccctaaggtcttcaagaagtgcaggacgacacttatcccaaagaccggggacgttagtctacatggtgacgtggggcaatggaggcccataaccattgcgtccctggtcctgagactctattcgcggatcctgacggaaaggatgacagtggcctgtcctagccacccgcgccagaggggcttcattgcctccccgggctgttcggaaaacctcatgctgttggaaggttgcatgagtctcagcaaggcaggaaatggctccctcgcggttgtgttcgtcgactttgcgaaggccttcgataccgtctcccacgagcacctcctgagtgttctggtgcagaaaggcttggaccaacacatggtggagttgatcaaggactcctacgagaacagcgtgaccaaggtgcactgtcaggagggttgttccactgacatcgccatgaaggtgggagtgaagcagggtgactccatgtcccctctcctctttaacctggcgctggatccgcttatccagcaacttgaacgcgagggccggggcttcccagtaaatgggaagtccattactgcgatggcatttgcggatgacttggccatagtgagtgactcttgggaaggcatgagagccaaccttgatatcctggtggacttctgcgagcttactggaatgcgaacccagcccagtaagtgccacgggttcctgattgagaagagtggcagcaggtcgtacaaagtgaacaggtgcgaaccgtggctgctgaacgacacagctcttcacatggtcgggcctaaggaatcaatcaagtacctgggcgtccaggtgaacccgtggacagggatcttcgctgaggatacggttgccaaactacgacagtgggtagttgcaatctccaagacgcctctacgtccgcttgacaaggtgtccctgttgtgccagtttgccgtaccgagggtcatcttcgtggctgatcactgcatgctatctgcgaaggccctgacagaaatggataggagcataagacaagcagtgaagaggtggttgcacctggccaggtgtaccacgaacggcctcctctactcaaggaaatccagcggtggtctgggtatcccaaaattgtcgatgattgttccggccatgcaggccaggagactcctgggcctgtcccgttctaaggacgagacggtcaggtggatgtttctggagacaactgatcacgtggcgtttgagagggcatggctgagggctggagggtcgccagatgaggtaccggagctgggtccggatctggtggagggctcccctgcggaggggaacgctgaccctgtcagcacggtgaggccaaggaagcgcatagtcccgtgtgactggcgtcaagtcgagttcgacagatgggccggtcaattggtgcagggaaaagggattcggacgttcgaagcggacaagatcagcaactgctggttgtacgactacccgccaaacaagctgaagcctggggattttacggcggctgtccagcttagagcgaacgtttacccgacccgggagctagcgggtcgcggaaggaccgatacgatagatgtctgttgtcgacactgtggggaggccccagagacttgctggcacatccttgcgctctgcccgaaggttaagcggtgccgtattcagaggcaccacaaggtgtgccaggtcctcgtcgcggaggctgagcgccatggatgggaagtggaaagggaaaagcgctggatgctgccctccggggagtgtgtcgcgccggacctgatctgctggttggatgagctggcgctcattgtcgatgtgacggtgaggtacgagttcgatgaggagtcgctagaacgcgcgcgaatcgagaaggaatgcaagtaccgccctctcattccagtgatcagggcgagcagagttcagacgaagaaggtgacggtctatggcttccctctgggagccaggggaaagtggcctgctaagaacgagctgctgctcgccgacctcggcctgagcaaggctcggactcggagttttgctaaactcctgagccgcagagttctcttacattctctggatgttatgaggacgtttatgcgttaaggaggggagtaggtctctactctgacccgaagggcccccccgtttcagacctgattctaggctacctgtgcctaattgggggggtcccaaagagatgttgtctgttgtagaagggtttgcgccactgactgcacggaagggtgggcctcgacaggtaggggttacatgactccgtgctgctcagcagacccgcgcctctgagaccgggtagggctacttgaacaagcgacgccctggtgtatgtccgtatcctaacctggtttgggaaagccgataccggcaatgcccgccacaggtgtcgcgcaccccacgggatgacgtatgggccccgggggacctcatggatactccactggacttgcacaatcctggtgtactggatgcagcgacgttggtgacataagcaatcgctaagtcggggtaggggaggtggggacctcggcacggctgtaggaacgggtgtatgggctccggcagccgtcgtcactcccatacaacacaggggctgcatcctggtggccggtgctagttggttctggaagcccgcccgggctggttcgcagaagcagggtgcgcccagggtaggtttggtatatctgggtccggtgcgatacctatcgatgggcagcgagggccgcctcgtgacgcgctgtgtggagctggagccggcctgggtatgaacagttcttgcggatgtggcgtagctagatagtacccgtggttgtgggcgtggtgtcgaccaaatgttgtcctgtgtgcacataggccaagggttacgtgggtggcagtcagaagcacccgcacctggaagtgattgccccgggatcccggctctctgtgaagagctaccttgaggaaaggtgttccgctggaactcaagaccctacagtaggggatatcaactggctttgaggtgctgtgattccggaaccagggcgagggcgagtacttagagcatgtccaaaagcccggggaacgttccgggggcctgcttgggtcgttggacccacatccgtaaaacgatggatctcgcgtcggcgctcgggagaacttcccgcatgaacgctgattgcatgtgagaacgcccccacggcggcggggcaggcgctccccctgggtgtaaggctcgggggggtcacggctccgctctaaaag

SEQ ID NO: 1544 - DNA, 4185 bp, Bombyx mori
gggcgatacgcataattttaatttcccgattgaaatccagtcgtcttaatctggtgaccagtggcgcggtcaccagtatagtgcacaggacgtgaatggctccgaggctggcggagtcactcactataagtgtgagagacgatgtcctgtgccaagtatacgtccaaccctaacgggttaagtgaaattagttgctcataacagggacggtgtacctgtttgctcgtggctggctatcgaatggacgggaccaatacacccccctgttagtaatggggtaagagagagcggtctgaaactatggccgaaatcacgacgccccactcctacccataacctgcacgtggtaccgccgcacattgaccgatacgggaggaggggcagcacttgaatcacgtagtcttggtgtagccattgcgggactacagccctcgtaagtgccgccttagaacgcaacggggcaataggtgggccggggcgctagcgggggggagtaatctcccctgttggcgtgcaccgcactgctcccactgggggcagtgtcatccggaaacaggtgggccggggcgccaccaggggggagcaatccctcctgatgatggcgagcaccgcactgtcccttatgggacggtgtaacccggatggctgtacacgtggtaaacacgtgacagcagccccgatggacggaccgcgaggaccgtcaagcctagcaggtaccttcgggtggggccttgcgatacctgcgggcgaaccctgtggtcgggtttgcagcccggccacagtgggtttttttcctgttgcaaaaaagtcaaataaagaaaatagacctgaagcctctggcctcccgctggagtcagagaggacaggcgataacccgactgtgcggggttccgccggcgcagatcctgtgggtcaggatgcgcctggttggacctgccagttctgcgaacgaaccttttcgaccaacaggggtttgggtgtccacaagcgtagagcccaccctgttgagaccaatacggatgccgctccgatgatggtgaagcggcggtggcatggcgaggaaatcgacctcctcgctcgcaccgaggccaggttgctcgctgagcggggtcagtgctcgggtggagacctctttggcgcgcttccagggtttggaagaactctggaagcgattaagggacaacggcggagggagccttatcgggcattggtgcaagcgcaccttgcccgatttggttcccagccgggtccctcgtcgggggggtgctcggccgagcctgacttccggcgggcttctggagctgaggaagcggtcgaggaacgatgcgccgaagacgccgctgcctatgatccatccgcagtcggtcagatgtcgcccgatgccgctcgggttctctccgaactccttgagggtgcggggagaagacgagcgtgcagggctatgagacccaagactgcagggcggcgaaacgatttgcacgatgatcggacagctagtgcccacaaaaccagtagacaaaagcgcagggcagagtacgcgcgtgtgcaggaactgtacaagaagtgtcgcagcagagcagcagctgaggtgatcgatggcgcgtgtgggggtgtcggacactcgctcgaggagatggagacctattggcgacctatcctcgagagagtgtccgatgcacctgggcctacaccggaagctcttcacgccctagggcgtgcggagtggcacgggggcaatcgcgactacacccagctgtggaagccgatctcggtggaagagatcaaggcctcccgctttgactggcgaacttcgccgggcccggacggtatacgttcgggtcagtggcgtgcggttcctgtgcacttgaaggcggaaatgttcaatgcatggatggcacgaggcgaaatacccgaaattctacggcagtgccgaaccgtctttgtacctaaggtggagagaccaggtggaccgggggaatatcgaccgatcttgatcgcgtcgattcccctgagacactttcactccatcttggcccggaggctgttggcttgctgcccccctgatgcacgacagcgcggatttatctgcgccgacggtacgctggagaattccgcagtactggacgcggtgcttggggatagcaggaagaagctgcgggaatgtcacgtggcggtgctagacttcgccaaggcatttgacacagtgtctcacgaggcacttgtcgaattgctgaggttgaggggcatgcccgaacagttctgcggctacattgctcacttatacgatacggcgtccaccaccttagccgtgaacaatgaaatgagcagccctgtgaaagtgggacgaggggttcgtcaaggggaccctctgtcgccgatactcttcaacgtggtgatggacctcatcctagcttccctgccggagagggtcgggtataggttggagatggaacttgtgtccgctctggcctatgctgacgacctagtcctgcttgcggggtcgaaggtagggatgcaggagtccatctctgctgtggactgtgttggtaagcagatgggcctacgcctgaattgcaggaagagcgcggttctgtctatgataccggatggccaccgcaagaagcatcactacctgactgagcgaaccttcaatattggaggtaagccgctcaggcaggtgagttgtgttgagcggtggcgatatcttggtgtcgattttgaggcctctggatgcgtgacattagagcatagtatcagtagtgctctgaataacatctcaagggcacctctcaaaccccaacagaggttggagattttgagagctcatctgattccgagattccagcacggttttgtgcttggaaacatctcggatgaccgattgagaatgctcgatgtccaaatccggaaagcagtcggacagtggctaaggctaccggcggatgtgcccaaggcatactatcacgccgcagttcaggacggcggcttagcgatcccatcggtgcgagcgaccatcccggacctcattgtgaggcgtttcggggggctcgactcgtcaccatggtcagtggcaagagccgccgccaaatctgataagattcgtaagaaactgcggtgggcctggaaacagctccgcaggttcagccgtgttgactccacaacgcaacgaccatctgtgcgcttgttttggcgagaacatctgcacgcatctgttgatggacgcgaacttcgcgaatccacacgcaccccgacatccacaaagtggattagggagcgatgcgcgcagataaccggacgggacttcgtgcagttcgtgcacactcatatcaacgccctcccatcccgcattcgcggatcgagagggcgtagaggtgggggtgagtcttcgttgacctgccgtgctggttgcaaggttagggagacgacggctcacatcctacaacagtgtcacagaacacacggcggccggattctacgacacaacaagattgtatctttcgtggcgaaagccatggaagagaacaagtggacggttgagctggagccgaggctacgaacatcggttggtctccgtaagccggatattatcgcctccagggatggtgtcggagtgatcgtggacgtgcaggtggtctcgggccagcgatcgcttgacgagcttcaccgtgagaaacgtaataaatacgggaatcacggggagctggttgagttggtcgcaggtagactaggacttccgaaagctgagtgcgtgcgagccacttcgtgcacgatatcttggaggggagtatggagcctgacttcttataaggagttaaggtccataatcgggcttcgggaaccgacactacaaatcgttccgatactggcgttgagaggttcacacatgaactggaccaggttcaatcagatgacgtccgtcatggggggcggcgttggttgagccttgcacagtagtccagcggtaagggtgtagatcaggcccgtctgtttcttccccggagctcgctcccttggcttcccttatatttaacatcagaaacagacattaaacatctactgatccaatttcgccggcgtacggccacgatcgggagggtgggaatctcggggatcttccgatcctaatccatgatgattacgacctgagtcactaaagacgatggcatgatgatccggcgatgaaaa

SEQ ID NO: 1545 - DNA, 4327 bp, Hydra vulgaris
ttcaagtggatgaagctgggaaggtaatctgtagttggttgagttggttgcagattactgctgtcgattttgctttctattgaaagcctgtctctacgggtcctgaagcttgaattttggtagctatagttttgtgggaggaaagtggaattttgtaccatcttttgtctctcgtatctactatagtaaatccggtcatgcagcctctacgcggcgcaactagaaacttggatcagtgatcaaggctaatgcatgccgggtctcctcagattaggagtataatacaaatctgacttcatcactaagaggctatggggctaacgatcctatagtctcgatgaacctattgattgttactagtagcataaaagaaagtgacgtaccctctagtggaaaggggggtgtagcagtcaataacataacagcaggagctagtggaaaagatacgtgcgtgatcatacacccaggtaccgatggtatttggtgctgtactgagtgtgtagagatacataacagcggtaaggatctgaaacgacatcttgcaaaacgtcacccgagtgtaacgataagcggttacaaatgcaatctgtgtccatttgttagtgaacgccaactaagtgtggggacacatctgaggtactgcagaggcgtaaaagaagtggttaaaagagagtttgcatgcgcgagctgctctttttcttcggatacgttctcaggacttcaggtgcatatgcaaagaaagcatatagcagaatggaacgaccagctgaaggagaaaacggagtttgcttggacagaccgagaattgagggagcttgctgagaaggaacttaccactccttccttcaggtacaacaaaattttctatgctgcgctaggtacctcccggacctacgacgctgtgaggaaaattcgctataatgacagatacaaatctgccattgctgaaatgcgatcacagatagcagatgcggctgccgctgcacaagagagggatgtagagcggggtttagtttcagcacactcagacagaggaaaagaaatgctccctgttgttgaaaccaaaagtgatatccaagtaaacaacgatatcaaaaaggatattgaattaacaccgaattcaagacagaaacaaactaatctagcgctggcaaggccagctgtaattgaggtggaggaagacttgggtaggcaggatgtgaaacaatatctcgcatccctgcgccaagacgactacacaagtccggccgagcggtcaatctttgcatactgcagggaggaaaccaattggtctgcgacaaaaagacaggtattaaagatatcgagaactaccagaggtttaagacaacctaagaaggttcgtccatttgagtttccggaagggttcaaacctaacagaaatatgagaaagtggagaaagtatagattccttcaggaatgctatagggaaaagagagctgagactgttagcaagatcctggacgggacttttatcgatgaaccggaggaagagattagaccagagttagaggaagtacaacgtatgtacattgaccggctggagaaaagaactcagctggataccacgaagattgtgcaaacagacgaggtgttttgtctgcaaagctacggtcgcattacgatcggggaagtaagagatgcactcggtgcaagcaagaaggactcggcctcgggtcctgacggcctgcttctacaggatgtgaggaggctgggaccactattattgtgtaacatctttaacatgtggtacttacatgggatccctgtggaagaaaacaggtgtcgaacaatactcttatacaagagtggcgatagacatctggcatcaaactatagacctgtgacaatcggcaacatgctgaacaggctttacgccaaaatctgggacaaacggatccggaagaacgtgcgtcttcatgtgaggcaaaaagcatttatcccggtggatgggtgctttgagaacgtaaaaacgatccaatgcgttctccagtcttacagaaagcgtaagttggaacacaacgtcgtatttattgatcttgccaaggcctttgacacggtcttgcatgactcgataaggaaagcgttgtggcggaaaggtgttccgtctggggttgttaaagtggtagacagcttatatgcgggagctgtcacaagcataagtgttggaaaaacgaaaactcgttctatatgtataaactctggagtcaagcagggttgtcctctgtcacctcttctattcaacctaatactggatgaactagcggagaggatagaggcaaccggctgcgggttagatcttgatggtcacgttctatcatctatggcctttgctgacgactacgtgttgctagcgaaggactccgtggagatgaacgagttgataagagtgtgtagtacattcttcaaagagaaaggcttatctgtaaacccaggtaaatgtcaatcgctaagagttcttcccgtaaaggagaagaaacggtcaatgaaggtccttgttagacctcatagatggtggaggataaaagaccaggatgttgacatcccatctatgacatatgacagcttaggaaaataccttggtgtttcgattgacccaactggtaagatagcgcttccgattgaggagtggaagaattggatgaccaagctaaaagagtgtaagctcaagcccgagcagaaagttaaaattctgaaagaagtggtttgctctcgggtaaactacgttttgcggatgtcagagtgtggcatcagcgaacttcggagttggacacgatttgtaaggaattgggcgaaaaacatcattcacttacccacatggtgcagtagtgactggatacactcgatcaaagggttaggcattcccgacgtttcgaagggaattgtcatacaacgtatgagggcttcggagaaaatgtctacgtctgaagacggtatagtccgcgtggttggtgcacgacttgttcagaagaacagagtcttgtgggaaaaggccggtttcgaaggtatcgaactgaaggcagccaggaggcactgcgaagtggagagactcaacaacattggtaacattaccaacggcgttgcactcaaaactatcgcagcagtctcctcggtaaatcggtactggatgattgaagacaacttgaaatccgggaacaagattctcgtttggaaagcaatggcgggtgccattccaacaaagattaacctttcgcggggcgtagcagaccagaccctcaaaaaatgtcgtcgatgcggtttaacagcggaaacggatggacacatcttggctggatgccatactagcagcgacgcgtactcaaaacgtcacaacatgctctgtgataaactcgccaaagagctcaaactcaatggtggaccaaacagacgtgtgtggcgcgagaggacgtgcttcactagtacaggcaggcgatatagacctgacattatcgttaaagatgacagtaaaatcacagtcatcgatatgacttgtccgtatgagaaatcagaaggacacctgatccaatgtgaaagtgcgaaagtaactaaatacgagccactcaagctagataagtattggactcgagaactcgagggagcaaatggtattgttgctgaaaaggtagagctgatgggattggcaataggggcgatcggcacaatcatgcgtagtacccttcggaaactctgtgagttaaagtcgggcaggatcgtaagacgtctacaaatgattgcttgtaataatagcgcccaaattataaagggtcacctgtcaagggcgactcggaggaatttgcggtgataaatgccaaaagttgcttgggctaaatgatacgtacgctagaaaaagcgacttgctgcacggatgacggttcatcagagcccgatatgtgcatgtcaaggcggcagggagaatcactagtgtagctgttctttccattacgacttacgcggttaacgtggcacgatagatttacaccaggaaataatacgtgaagggttccaccatatactggagtttagatctatgagggaaacatttgtaataagtcagtctggtaacctggcgccgctgttgagtcaaattaactatgtcaatactcattaagttatcgactttgatatggcatggggtgattccgcgttatatcaaagtcaaacatgatgattgcaatgagaaactaccacgcttggtcacgtttgtgaggagaacatctcattcaagcctcccggatgtcggcacccgctgacatcttctggcttatgaaaattttcattaatttttgtaagtcatgggcggcttgaaagc

SEQ ID NO: 1546 - DNA, 4265 bp, Hydra vulgaris
cttggggtcactgacacatttttcggtagccatagttttttgagaggaagagtggaagtttttccatgagtcgtctctcgtataaactgtggtaaatccggccatccagcctctacgcggcgcaactagaaacttggatcagtgatcaaggctaatggatgacgggactccatggataaggagatataaagatcttatttgaacgcatcttaaggggttatggggctaacacccccttaattctggtgcacatttattgaccgttatgagcaatagaatcacgataggtgatgtaccctcggtaggaaaggggggtttaactgtcaataaacaaacagcaggagctgatggtgctgaagcgtgtgtagtcatacacccaggtgccaagggtatttggtcctctcctgcgtgtttaagaaagtttacgatcggaaaagaactaagggcacatttggctcaaattcataaacttgcaccgagtgcagttcggtacaggtgtaataagtgtccgtatgagggtgatgtccaactcagtgtgggaacacatctgaggtactgtaagggtattgcgggagtggtggaggagaaaaagcaattcgcttgcgcgatttgtaatttctcttcggataccttttcaggacttcaggtgcataagcaaagaaagcatgtagttgaatggaacgagcagctgaaagagaaaacggagtttgcttggacagacagggaactgcgggagctggcggttaaggaagtaacgattcctttctctgtggtgaatacggagacctttgctgtgctagatattacgacgcggactaaggatgctgtgaggaaaattcgctacacggatagatacaaatctatcctggctgaagtacgcgcacaagttaacgctgtggcggaggaagcgccgcaagctagtgatgagagtcaaataacgctcttagttaacacaggcaggggagcagaattacaacctgctgtgattaatataactgattcaattgaattagttactgatgtcaatgaggttgaaatggtaacatcgaattcaaccaatgaagaacagcctatcaacgcgccggtggaaccggctgtaattgaggcggacttgggaagacaggatgcgaaactatatctcgcatcgctgcgtcaaagcgattgcacaaacgcatctgatcgatggacccttgcgtattgcaggggagaagttgattggtgtaagacgaaaagcaggcttttcaaagtatcaagacatgcccggggtttaagacaacctcaaagggtggagaattgggagtttccagagggattcagacctaacaggaaccttcgtaaatggaggaagtattcattcttgcaaagttgctatagaacgaagaagaaggaaactgttagtaagattcttgatggtactttcaaggacacacctgaggaagagattaggccagagttggaggaagtacaacgtgtgtacgttgaccggctagaggtaagaactcagctggataccactaggacagtgcatatagacgaaagattcgatttagtaagctatggtcgcattacgatcagggaggtacaagacgcaatcagcgcaagcaagaaggatgcctcagggggtcccgacggcttgctcctacaggacgtgaaaaaggcgagcccacgccaattgtgtatcatctttaatatgtggtacttgcatggaatccctgtagtggaaaataggtgccgaacaatactcttgcataagggtggcgagaagcatctaacgtcgaactaccgacctgtgacgatcggcaatatgctgaatagggtatacgctaagatctgggacagacggatcagaaaaaacctgcaacttcatgtgagacagaaagcattcgtcccgctggatgggtgctttgagaatgtaaaaaccatccaatgcattctccagtcttacagaaggagcaggcgggaacacaatgtcgtatttgtcgatcttgcaaaagcgtttgatacgattttgcatgattcgatagagaaagcattgctgaggaaaggcataccgcgaagtgtgataaaagtggtagacagcttatatgcgggagctgtcacgagcattacggttgggaaaacaaagactcgacctatatgtataaattcaggggtgaagcagggttgtcctctatctcctttgctgttcaatctagtaatagatgaactagcggagaggctggaggcaactggctgcggtcttgatctggaaggtcacgtcatttcttccatggcttttgctgatgactacgtgttgttggcgaaagactcggttgaaatgaacgtgctaatgaacgtgtgcaatacgttctttgaggagaagggtttagctgtaaatccagcaaaatgtcagtcgttacgcgttttgcctgtaaaaggcaaacggtccatgaaagtccttacgaggacgcatagatggtggaaaattaataaccaggatgttgaaatcccatctatgacatacgaaagtgttggaaaatatcttggggtaatgattgacccagctggtaagattgctcttccgattgaggaatggaagctttggctaactaggttaagggagtgtaagctcaaacctgatcaaaaagtgaaggtgctgaaagaggtagtttgtgcccgagcaaactatgttctccggatgtccgggtgcggaatctgtgagctccgtaagtggtcacgatttgtgaggggatgggtgaaatccatcattcacttccccgcatggtgcaatagcgaatggatgcattcgagcaaaggcttaggcattcctgatgtagtgtcaggaattgtcatccaacgaatgagagctgcggaaaaaatggctaagtcaacagacggagtagtccgagttgtcggggcccgcattgtgcagacaaatagagttttgtggaaaagggccggattagcaggcatagaactggatgccgccaggaagttctgtgaggttaagagggtgaacaaaattggcaatcaaaccaatggaggcgccctcaagactatagcagagtcctcggtgagccggcactggttattggaaaagaatataagacctggaaacaaaattctagtttggaaggcaatggcaggagtgattccaacaaagatcaatctgtctagaggcgtagccgaccagactctcaaaaaatgtcggtgttgtggtttaacagcagaaactgattgtcacatcttggccggatgtcctaccagtcgggatgcgtactcgaaacgtcataacttgctttgtgataaactcgccaaagagctaagactcaatggtgggccaagcagacgggtgtggcgcgagaggatgtgtctctctgggaatggcaggcgttataagcccgatattgttgtgaaagatgatggtgtaattactgtcatcgatatggcatgtccgtacgagaaatcggaaagacacctaagtcaatgcgaagatgcaaaagttgctaagtacgagccactaaggcttgataggagttggactcaagaacttgaggggaataacggcagaagtgctaatgaaatatcagttgtagggattgcagtaggggcgattggaacaattacgcgtaaaacccagcggatacttagcaagttgaaactggccaaggtcggaagaccgttacaaataattgcatgtaatgaaagcgcccaaattataagacgacatctttcgggatcgagacttagaaatttgcggtgaatgcccgaggtagttgggataatgatgcacaagctcgtaaggcgacttgctgcacgtatgccgctaaacgcttagctcgatgagtgcatgtcaagacggtcgggagtatgatcagtggagctgactttccagacaactcacgcggattcgcgtgcggtggatacaacacctggtataacatatgaagggttccatctagtacagggataacgatccatgggagcaaactaattagttggaggtaatccaacgccgctgttgagtcagtttttaaccgccagtcaactcttgtaggttatcggtcttcggcagaccttggaccgcctagcgccggccaacagtttgtcgtcgactaacatgatgatttgcgagagaaacccacgctttgtcacttatgtgaggataaaatctcttgtccatatgatcctttgaagggaacagcgctttgagcttgctcggcgttggcacctttagtctgtaatattttcttgatattatggacgaaaaaggtagtatggttgca
